United States Patent 7,745,391 (HUMAN THROMBOSPONDIN POLYPEPTIDE) - sequence listing, part 16

SEQ ID NO: 38808 - DNA, 549 bp, Homo sapiens
tgtcgcctccttctcctggtgtccatttctggaactgctatttgtatattgcatgatattttatcaggaaaaaatataaaacagatctaatttcatgaaaatgctgttgccataatgctcaggagaacagggggaagagagagattcaagtcttcctaatgtctaccttatatgcaggtacattttacaagttctattgtattctgacttattaagcagtgcatatttctttcttttacattagctttcattgcagaagggtgtggggagatgagactgctggaaactgacgtgggattgatgtttatcagggctgtaggcttcagaaatatattaagcctcggaatgtcctaggtatgaaaaagataataaataacaggtcaatttattatattccctttatctctatattacctgagagagattgctatactgcagtgacactttcaagatgccccaatcctccaatctccatgcataacaatttgaaaaagggaaggttgactaaggctgggatgttcaggatcaatttctaatcagtttcaggtt

SEQ ID NO: 38809 - DNA, 241 bp, Homo sapiens
ggacactctataatctactgttcatttccttatattataaagttaactggcatctgtgtgaggaccttaagccatttacaagtacgtactgtgggaatataaggctttttttttttaagggtaagaaaactcatgtacactattttaatggtatgatttaaatgtgttcaaaaaccttgtgtttttcaaatcccttttcaaagtagccccaataagctggggagtatgtgtgtagtggcgt

SEQ ID NO: 38810 - DNA, 386 bp, Homo sapiens
tgatgtgagatgccccagtccctgtgtgtgggataagtgaggggaatggtgtaggcattgtgacatagggctaggctgctcctgagcttcctgtgatatgtcgggagggtcacgcagccatgacagtgtcggtggttgtgtgtcaggagcagatgatgtggccgactgacgggcgagccacgtttgcagccggggtacacaggacaaaggggtggcacacatccctggggggatggtgcaggatgtcatcgtgctatcagattggcatgcaatttaaaacttagggaatgcttttttctggaatgtcccatttaacgttttctgactgcagctgatttcagttaactgaaactgcagaaagtgaaaccatgggtaagtagggacag

SEQ ID NO: 38811 - DNA, 367 bp, Homo sapiens
agggctttccctttcccagtgataatcagagctctggagaggtgaggttgctggcttgtccctaccctcagatggctcttaaggcaccccttcaaactccagggacccccaggaacccagctgcacaaccactgctcaggaccacttggtccctttattcaaagggcaaaaagggtccaccaggacaggtccccaggggctgcagtaacgaagtcacagataaggctgctttgcaggcagctgggggcatgcgggtgcagaagcatgctgctgacgtgtctatgggtgcattctctcatttgccctgttcactgtattagcagtgtgcttagtagaccaagttttcatccatggagcagaagtcaac

SEQ ID NO: 38812 - DNA, 491 bp, Homo sapiens
aatgaggtcctgtctgtcctgtccgagcaaagcgtggaccagcgtatgtaggactgtgatgacaaccctggggatcttttctagcccataggattcttgatggggaaacattcctagacatacagtcctcccactgaactccacccccatccagaatctctatcaggagctaggagccggctcagtgggctgggaagggcctttcagtgccctttggacggggccctggggccttgccaagctgaacgtgtcctctgggtggcctgcctcacctctggcctgctgcccatcagcattgaatcatgcccctcagaggacagcatgtaactgtgcttcccgatatagcccccggccccccaaggtgacaggaagagtcattgtcacgggagtactccatctttctgacaccacaaggccggcgtggctttcttccctactgctcagccctgcacagcctagaattctgctttgggagcatacatagagttcac

SEQ ID NO: 38813 - DNA, 99 bp, Homo sapiens
taatgtcctgaaggagatcaggcagaggagagaagagtcagtgtgaactaggctggtggctctgtccggtagggagatggaaagggtgccgcccatcat

SEQ ID NO: 38814 - DNA, 363 bp, Homo sapiens
ttttatccagcgtagtgctggaagttctagccaaagcaatcagacaacagaaagaaataaagggcatctaaattagtaaagaggacgtcaaactgttgctgttcaccgatgatataattgtatgcctagaaaagcctaaagactcacccaaaaagctcatagatctgataaatgaattcaataaagttttaggatacaaaatcaatgtacacaaatcagtagcactgctgtacaccaacaacaagactgagaaacaaatcaagaactcaatcccttttacaacagctgcaaaaaataaaataaaatactttggaatatactgaaccaaggaggcgaaatatctctacaagaaaaactgcaaga

SEQ ID NO: 38815 - DNA, 346 bp, Homo sapiens
gaggttgtagtgagccaagatcatgccattgcactccaacctgggcaacaaaagcgaaactctgtctcagaaaaaaaaaaaaaagttttatcacttgtatacatccctttctaatattattaattcatatgctagttaattttttttttgctagttatataactagcaaaaaagtaaggatgattttgaatcttcccatactgagaggtcataaaaattcaggtccatgactgaggaacaaaattatcaagatggaacagtgatttatgggaatttgtaacacctttataccatagacatcatcaaaagagataagtctcaggctccttactatcatgccatatta

SEQ ID NO: 38816 - DNA, 375 bp, Homo sapiens
ccaggggcctccatagccgccttcaggagtgagtgcactgcggtctgagcacctggatgtagccctccacccttaccctgtgcctccctaaagcctcgtgtgtcaaatgaagtcatcattatccctacctcgtgagatgtcacaagaataaataatttaatatatgcaaggtgcttggcaccgagtgttataaaacttgatgatgatgatagtttgctatcatcatcatcatcatcaccatcatcactaccaccattcagtacatagtttcccacctttgcacttttaaaaaaggaaaacccactgccatatgtaatatgatttctttaccactttgttgaaaccaactttaaataaactcacttttaaaacgta

SEQ ID NO: 38817 - DNA, 293 bp, Homo sapiens
  misc_feature (138)..(138): n is a, c, g, or t
  misc_feature (144)..(144): n is a, c, g, or t
aacaaaacctggatttcaaaactgttttcagaaatttggtaagcttaaatcccatgccacaattgttgtttcaattaataattttgccacctattagctacgtaaaagagagattggcgctccagcaccaaagcaaangagggncatcatcatcaccatcatcactaccaccattcagtacatagtttcccacctttgcacttttaaaaaaggaaaacccactgccatatgtaatatgatttctttaccactttgttgaaaccaactttaaataaactcacttttaaaacgta

SEQ ID NO: 38818 - DNA, 573 bp, Homo sapiens
cctttttccccaacaagggggtaattgggtttctacgggagaacaatcctcttagggggttttcccttttgtgaaatgagggagtggtttgatccccacttccacaacacaaccaggaaaggggtggcatgcctaaaaatgtcattgtaaagaagatgcgatgcagtgctactgctagaagactatttgcagaaattttctaccagctaactgaaattaagcattgggccagctctagccattcatccctctggatgtgtactgttgaattagtttcccagcgtaacatagactgcagtggtctgggccagctctcaacagagtaacaaggaggcaaggtctttgggcctgccctgtccttcctgtaccccatctctcattgtcctgaatgctcagtttcaagaaccaaactatgctcactgtggatagtttgcttctgtgcatctttgaaactcattgatcagggatctccgagaggatagggactgtatctgtctattcaccctgtgcccctgccttcccccattgcaccttcctcttcagaaaaaaaaaaaattcatccaactgtttata

SEQ ID NO: 38819 - DNA, 648 bp, Homo sapiens
gtagaaagaggacctggatcctcaattgggacagattattctccacttcggtccaaagtttccccattaataaagtaagggacttaggttaaataaatgtctcatcaaatagagggtagtgggcagattttccaaagaagagataattatttgatgaagttgtaagaaccctctggatctaaagagttggctagcgatcatctactaagggaacttgattctccccaattagaatcttacagttaaagaactgacacaaagacatcaaaccccagacagttcttaaactctcttccacgacggcgttctctgatatagcaacttctgctctttcattttagacatctacaaacaacaataaacccaataaatcacattaataccctttaaaggacaatgatttctgaaatatgttgcatggagattttccactaccttcatgtctattagattatttaattagattaaataatctaatacttaactgtctattagattatttaactctctatatgatgtaggcttaaaaaaatgcaaactaattatgtttaatggtaacaatgtcttataaactttaaatcctgaagattattcaccaaattgtactcttcaaatgtttttacatgctattcctaaagacattatgcc

SEQ ID NO: 38820 - DNA, 377 bp, Homo sapiens
atggaattaggcttgaaagattcatgatgggggagggtcctgggaaaggggcctgtgctgaggttatcagggaaatcagctgtattataggaatgggaaagaggccaggaaacaggataatgagggagtgggatagcctggaggtagaatgatttataaaaaaagattagatccaaattctggctgtctttgttagagtatggaggcaggaattaattggttatgtggattgtaggtaaccattttgtggcaagatgacttaaaaggtaaggtgactcatcctaattattttttttttgctcactaattttctatgtactgtatagtcacttgcacccacagaaaaacaaggggaaagtttactcaggaaaaaaaaa

SEQ ID NO: 38821 - DNA, 1112 bp, Homo sapiens
ccattagatgacagtagcacttcttcctgcttccagttctgacaactaaaaaatatcccagacattgtaaaaacatcccctggggagcaatgctgcccctggatcctaccattctagttgaagaagttggagttaaaactccctttccagactcccttgcaactttgtttatagacacaaatccatcccaccaattgcttaggcactgccatgggacacttgggacagcaaatgtgagggaagggccatatccagcttctttggggcttctcctcttagcaagggagtgtgtgaaggaagttttttgtcttccggttctggggtcccttctccagcttccttgtggtggagatggggccacagcaacggaggtggttttggcttatccatctgcttagctccagttgtagcttcagtggaagggccttcctggagggtcacttctgtattattcaggaagccgttctgaaggtcaacctcaaaactactcttttagctcttctaacaatttttaagtaccaaattgcctttattaaatctctcccttttaaaaacatgaagaggttcgcataccctatgtggaggcccgatgaagagaacctgccagggagttatcaagtgaacaccacgtgtctcatcaggaagactcagacacgctctgaaggtgcccatgtctgagctgctgtacctgctattccctctgttcagaatgcactttcttccttttattccccatcactcaacttccagggtggtctacctacaaacacccatgtagattccaaagcccatctgatgcctgctcttctcaggggtaaagcttcctccttcttatcctcaccccctgctgtcactccttcacctgttccccgcagataacaactcctgtctctcacctacctctcttggtaactttgtcacgccccttgccacactaaatgttctaattgtttgttcctgcttgttcttactcaactgttcccagggcctagcccagagtaagaatataatgaatgatgagtggatatacaaaggaaagaatggaatcttggaatgtcattcctggttaccttacgacatttatcttgtggtccttgccctcaaagtactta

SEQ ID NO: 38822 - DNA, 1096 bp, Homo sapiens
cacatgcctcacactctcctgggggttaatacactgaatctgacaattaacaggccaagtatatacaatcaagcaacaagtcattattacccccagctcctctgagcgaaagtcaacgttaaggggctcaggtgaaccatgatgatgaccttctgttgactttgaaatattggctcttgtgggtgacaaaagccagacaagctgtggctgtggtccgattttaagacgaggttctcaaagatccaaaggagggaaagggtattggaaacactgtgtatcatctgagacacacgtgtcctcatgatcttaaatgcctactttaaagccacctaatactgcccttcattgtggtcagaagagatttctacaaaagcactcagaattctggaggcagttgtgattttgccatgtggcagttggtttgtggagttgggcaggtgtgaaagggtaaaactccacttctgaatgctgcttctgccccctgggacccagcacattgttagaccatcttcttgactggaaattctctcctgatgctgagccctgcaccaccaccttccttttcctaactatgaattgatggcaaagtccactcaaaacaaccagttaagtgctcacgagagagtagtcaagcacctccagaaagaaaccgggtttttgttcacatagcaggaagtgactccctgggtggtaatttatcttggaaacacaggtagattggcagaaaaacgggaacatgtaggtaccgcgatgttggtgcatgtccattactttgggataggctttctcagtctttcctcaaatgatagttgagccagttttccagtggcaattctgagtgacttgcgcttgtcttatggtgtggtcaagggacgttcagaactacggaaaacttttactgaaacagcgaagcagagtataccggcatgagagggaagatgaacactcacctatgtaccactctttgacaataaatatagtatttctcaaatcagtctcaagactgatcctgtctcagaacagaccattgttctctcatttctctaatacgctgagaggaacactctgaataaaggctaagtggtgaggattggaa

SEQ ID NO: 38823 - DNA, 353 bp, Homo sapiens
tttttttttttggagacagagtctcgctctgtcgcccaggctggagtgcagtggcgtgatcttggctcactgcaagctccacctcccgggttcacgccattctcctgcctcagtctcccgagcagccgggactacaggagcccaccaccacgcctggctaattttttatatttttagtagagatggggtttcaccgtgttagctgggatggtctcgatctcctgacctcgtcatccacccgcctcagcctcccaaagtgctgggattacaggcatgagccaccgcgcctggcccattgatgagtttctaaagaggagtgtgatgggatctgatttcttaaaagatccatatgg

SEQ ID NO: 38824 - DNA, 407 bp, Homo sapiens
ccctacatacctaaccttcccttacattctctcctcttctccatgaaaccactttcaggcgatttcttggaaacaacccaggcctgattctcttcaagacaatatatgagtgtgtgtgtgtatgtgtgcgtgtgtatgcgtgcatacatacatgtgtgtacatacatgtgcttctttgtcacttaaaatttgtagaaaggtgtttaaaatcaatcaataatatgccatttatctgaacgctacttcctgttcatttgatgcccataggaatttagttaaaaagataactattggctgggcgcggtggctcacacctgtaatcccagcacttcgggagaccaaggtgggcagatcatgaggtcaggagatcgagaccatcccagccaacacagtgaggagcaatcata

SEQ ID NO: 38825 - DNA, 387 bp, Homo sapiens
cggcacgaggctcactgacttcaagaatgaagccgtggaccctcacggaattcaaggtctccttgggagtctcatgtccttgccaagccttcgccaggctctcgccactgccgttcctctaccagcccaagtctacattctgaggctctaggaacacgagagagaactccagtgctcacatcccatattgaccctctttatgttcttcaattaccacctacctgaaaaagcctcaaagtctcaggggaacattctggagtccctgctgctgaagagggttttttgagttttggtcgtcttccaaagtttactgtatgaagtcttagtgcttcactggagtttgtcatatgtctggataataaataagtttcaaaaatgtaactaaca

SEQ ID NO: 38826 - DNA, 348 bp, Homo sapiens
caagcctgatttagcgctccatttctttcccttataaatcctatctttaacctcagaccattcattgtttaggaattcaaggtctccttgggagtctcatgtccttgccaagccttcgccaggctctcgccactgccgttcctctaccagcccaagtctacattctgaggctctaggaacacgagagagaactccagtgctcacatcccatattgaccctctttatgttcttcaattaccacctacctgaaaaagcctcaaagtctcaggggaacattctggagtccctgctgctgaagagggttttttgagttttggtcgtcttccaaagtttactgtatgaagtct

SEQ ID NO: 38827 - DNA, 476 bp, Homo sapiens
actcgacagatgcctcaaaatctcttactagatgagcatttaatcacttcgtatactcaatactcaaattttcaatgggtgtataataatttagctcaatagttttggggtttatttatttattattattacttttttttttttgcagagtttctgagttcagtcagggtagatcggtaactttaagaggaaaatcaggtttgatatttttatttagtgctgaataaatttattgaaccagaggtcttcctgtagtacggagaagtccacaaaataatttcgaactggttcctaccaaccttagggctggaccatgggaaggcggctggcattcaggcagttgtgaccatgctccggtgtgtggggaggaggagactgccacacaccacgtgacgcagaaaggaagtctgattatttgtctctcatatgcctgcacgcactcattcatgtctggtctttagccagtatggggtcac

SEQ ID NO: 38828 - DNA, 537 bp, Homo sapiens
gcggccgcctactactactactgctcgaattcaagcttctaacgatgtacggggacatggtgggatctctggcccctcagggacttgagattatttaagtactagttcctaacacgttctggaaaataaaaataactctgggttaaggtttaaagctgctgctgctccttctccagcctccgactggtgggctgcatatctttccttcagcaaagcaggactaattgtgtgtcccggagtcacctccctcaggttgcgggcctcaacccctccgaacctggcttccttgtcagtgacatgggttgtgtaattatcaggttagactgtgacgtgcctgatggagcctgacacataggtgctcaagaaatggtagcagcctttcccgttaagaaagttggaagggggccaggcgcggtgtctctcgcctgtaatcccagcactctgggagaccgaggcgggcggatcacttgaggtcaggagttcaagaccagcctggccagcatgcgaggccccgtctctactaaaaatacaaaaaaa

SEQ ID NO: 38829 - DNA, 1112 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgggcgcgtcggccgcggagcgccggctgcggcacctgggtggtggggactgggaaggaaacgtggggggcgtgcacctcattgagcacctgttttgtcccaagcttagtgcgatataccgtttaagcctcataacaattggaacggtaggcatgatcgttccctttgtcggttggctcccagagggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggttta

SEQ ID NO: 38830 - DNA, 1223 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggtacgctttcgtatgggctgtaagggaaaagggagggggatgccgccttctgaagacacatgttggtcagttcccctgaaaaaccctgggcattcttaattcccaaattaatcctactggaccactctttgatcttctttcatacagtaaaaatacaatagctgggccaaggggaagttttcaggacagctcattccatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggttta

SEQ ID NO: 38831 - DNA, 1608 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggtacgctttcgtatgggctgtaagggaaaagggagggggatgccgccttctgaagacacatgttggtcagttcccctgaaaaaccctgggcattcttaattcccaaattaatcctactggaccactctttgatcttctttcatacagtaaaaatacaatagctgggccaaggggaagttttcaggacagctcattccatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggtttaaagctgctgctgctccttctccagcctccgactggtgggctgcatatctttccttcagcaaagcaggactaattgtgtgtcccggagtcacctccctcaggttgcgggcctcaacccctccgaacctggcttccttgtcagtgacatgggttgtgtaattatcaggttagactgtgacgtgcctgatggagcctgacacataggtgctcaagaaatggtagcagcctttcccgttaagaaagttggaagggggccaggcgcggtgtctctcgcctgtaatcccagcactctgggagaccgaggcgggcggatcacttgaggtcaggagttcaagaccagcctggccagcatgcgaggccccgtctctactaaaaatacaaaaaaa

SEQ ID NO: 38832 - DNA, 860 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagaggatggtcagaacatcgagtccaggaataattcgagtggcatcgataaacaccatcgatgccacgaagagaaaagagaatcaggaggaacaaacatccattcaaagtctgtttaatcagagattttttttttctgaaaatgcacagtggcatttcaatcaaaaaacccttcatctgcagacctgcggaagggaggtggcctgggtcccttccctcggaatatcattagtttatttacctccttcattggccatttgcaggctcattctccttgaaaaatgaatctttacgcattctaccaattataaaatacagtgactgttagctaccaaaggctgcactaggatttcttctgtgtccaacacgaccaagagcgtaatgacgttcggttactcacggtggcatcgataaacaccggtaccgac

SEQ ID NO: 38833 - DNA, 925 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggttta

SEQ ID NO: 38834 - DNA, 1310 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggtttaaagctgctgctgctccttctccagcctccgactggtgggctgcatatctttccttcagcaaagcaggactaattgtgtgtcccggagtcacctccctcaggttgcgggcctcaacccctccgaacctggcttccttgtcagtgacatgggttgtgtaattatcaggttagactgtgacgtgcctgatggagcctgacacataggtgctcaagaaatggtagcagcctttcccgttaagaaagttggaagggggccaggcgcggtgtctctcgcctgtaatcccagcactctgggagaccgaggcgggcggatcacttgaggtcaggagttcaagaccagcctggccagcatgcgaggccccgtctctactaaaaatacaaaaaaa

SEQ ID NO: 38835 - DNA, 1076 bp, Homo sapiens
cggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagaggtaaaaatacaatagctgggccaaggggaagttttcaggacagctcattccatcaggaactcatggccttgaaccaagcttgccaggaagtggggaaaaggcagtgctttccttgacatcacgctagcaagtttctgtcgactcttatgcaggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggttta

SEQ ID NO: 38836 - DNA, 516 bp, Homo sapiens
gcggccgcagtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgggcgcgtcggccgcggagcgccggctgcggcacctgggtggtggggactgggaaggaaacgtggggggcgtgcacctcattgagcacctgttttgtcccaagcttagtgcgatataccgtttaagcctcataacaattggaacggtaggcatgatcgttccctttgtcggttggctcccagagggtaaggtacttgaccaaggtcacccagctagtcagagtccacaaggggccacatctggctctccaaaacccacaacacaccgccttgggactacctccgacctgacttcctgctttgcccctccccgtcaggtgtggcacggatcctgacccacgaggcgggaatcactgacattgtggtgttacag

SEQ ID NO: 38837 - DNA, 530 bp, Homo sapiens
ttggctcggctgcggatcgtccctccctccggaagtgcggacattgtcagctgcgtttccgcggtcgcggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccaggatggtgttactgcagttgaaagggcaatctgaagttactttcttaatgtgacctagcaataggcatagctacgtggcactatattctggccagactcgatgtgtactctaacttaagaaataaatcagtaaggcagaacaa

SEQ ID NO: 38838 - DNA, 446 bp, Homo sapiens
ccgctccaacatcagaatggtaacgaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38839 - DNA, 791 bp, Homo sapiens
agaacaaacaaagaaatagctagagccgctttatcggcacgagggctggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38840 - DNA, 1005 bp, Homo sapiens
ttggctcggctgcggatcgtccctccctccggaagtgcggacattgtcagctgcgtttccgcggtcgcggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38841 - DNA, 884 bp, Homo sapiens
  misc_feature (37)..(37): n is a, c, g, or t
  misc_feature (43)..(43): n is a, c, g, or t
ctctggatccccgatcactcagaacccggagaacccnacgaantcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaacaacagaccaaaaccagaccacacacaaaagaaaaacaccagggaaaatataatgcgaagtatgcgagaaaaagagcagtctagtaatagagacatgtgataagaatggtatcgagaaaccccacgtaaacttgttgcacaaagtgataaaacaagcgaggataacgcaaaagacgacgatatcaaatcaaacaaagcagattcaacataggaatataatgggaaaagcagaaagaagaagagatgaaactgaaaacgagcgatcatcaaataacttaggaacaaaaggaaaataac

SEQ ID NO: 38842 - DNA, 903 bp, Homo sapiens
gtggctgatctagaggatcccagaggctgaagcggctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38843 - DNA, 971 bp, Homo sapiens
  misc_feature (827)..(827): n is a, c, g, or t
  misc_feature (840)..(840): n is a, c, g, or t
  misc_feature (842)..(842): n is a, c, g, or t
  misc_feature (851)..(851): n is a, c, g, or t
  misc_feature (859)..(859): n is a, c, g, or t
  misc_feature (861)..(861): n is a, c, g, or t
  misc_feature (865)..(865): n is a, c, g, or t
  misc_feature (870)..(870): n is a, c, g, or t
  misc_feature (877)..(877): n is a, c, g, or t
  misc_feature (889)..(890): n is a, c, g, or t
  misc_feature (893)..(893): n is a, c, g, or t
  misc_feature (903)..(903): n is a, c, g, or t
aaaaacattaagctagtacgaggcgcgggtgaatcggcgaggtgaggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagattccagagaantgaagaacaaaantntggccggantaatcgcntnaatnatgtnttacaanaaaaaaaccggnnctntcgggggggnaaaggttctaagggctgccacgttcgacctttgtaaaggggaatggcggccaagaggaaatgaacgcg

SEQ ID NO: 38844 - DNA, 511 bp, Homo sapiens
actgacatttaaaaccctgaatttttatttctgtatacaaaaaagagaactttgagacagtccctaagtaggcaattcgttttcacacgttcttaaaacatattccacactcccttcgctttccgccttcctgcctcctcagatctcgtttcttcggctacgaatctcgcgagaagtcaagttctcatgagttctcccaaaatccaccgctcttcctctttccctaagcagcctgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccgggcggcctctgaggtccgcagagggacgtgatgggcgggaatggggactaccgggctcctccactggtgggggcgccggcccgccgtggggtgcgggc

SEQ ID NO: 38845 - DNA, 833 bp, Homo sapiens
actgacatttaaaaccctgaatttttatttctgtatacaaaaaagagaactttgagacagtccctaagtaggcaattcgttttcacacgttcttaaaacatattccacactcccttcgctttccgccttcctgcctcctcagatctcgtttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38846 - DNA, 819 bp, Homo sapiens
  misc_feature (2)..(3): n is a, c, g, or t
tnngctagtagagccggtggttgaatcggccgagggcagcctgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38847 - DNA, 614 bp, Homo sapiens
tttagtcacaagtttttttaattgccttgcccccaaagaatagaaataactcgacattttgaaaagctgaaaattgaaaatttaacgtttactttaaaaattaaagctttgatctagttaaccaacactttattcttcatacttagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaaggttacccaaaccactaacatcctgtgcaacttgggtggttgtttaattaatgttggctgttcagatttatgtccttgattttcttgttttcagtaattaactcatttaggattttttaaatttctacctgcagtttccacagaatgaaactatttccttttattttttttgagtccctttatggcaaaattctgtgaagatccagaagcgtgctctgtggtctctttaagccta

SEQ ID NO: 38848 - DNA, 988 bp, Homo sapiens
actgacatttaaaaccctgaatttttatttctgtatacaaaaaagagaactttgagacagtccctaagtaggcaattcgttttcacacgttcttaaaacatattccacactcccttcgctttccgccttcctgcctcctcagatctcgtttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaaaaacacgagaagaaacccgggcggatcaatgcggggggccggcaaaagcggtcccgaaagggccactggccatgctgtttccgggcccagttttctgtcccagggggaactctccggcccctaatgggggcccataatccgaaagccgttacg

SEQ ID NO: 38849 - DNA, 601 bp, Homo sapiens
tagcttgagttctttccgtatggtagcttggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatattaacgcagagggtgaagaaacaaa

SEQ ID NO: 38850 - DNA, 658 bp, Homo sapiens
gcggccgccgactactactactactactactactaaattcgcggccgcgtcgacagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38851 - DNA, 653 bp, Homo sapiens
gtggctgatctagaggatcccagaggctgaagcggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38852 - DNA, 1080 bp, Homo sapiens
gcacgcgcgatcgggaagagtggctggaagacgcgcgcgcgtcacccaaggcggagtaagggcatgcgctggaaaggactgcggccgagacgcccaggacagttacgcgaaaagagagctccggatacggcggagggcagcccgccccatcccccagagtccgagaagaaatcctggcgcctcgactttccgggcccccgctatttacacaccgaggtcaccactcccgccctggctctcgcctcgtttccgcctccaaacggggacgggctttcttgaggccagcccttcccggctgtatacacggccccagcgccccgccggctcgcttttccctgcttccctgaaagcagccgggagccgcacggcttactcaccatagtggctagggattaggaggcgaaggcgacaggagcagacaccgggtcccggttaccgtccccgacaagctaagagtcgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaataaaaggaaaaaaaaaatggatg

SEQ ID NO: 38853 - DNA, 1750 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38854 - DNA, 891 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38855 - DNA, 1696 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38856 - DNA, 1975 bp, Homo sapiens
  misc_feature (2)..(3): n is a, c, g, or t
  misc_feature (1707)..(1707): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatcctaaanaaaagaaaaaaaaaaaaaaaaaaaaaaaaagaagcaccaggaaaacaacagaagcgcaaaaaacaaaccataaagcaaaaagcaaaaagacaaaaaaaaacaacagaacacaacacaacaaaaacgaacaaaccaaacaacagagagcacacacaacacggggaagacaaccgcacaaacaagacaacaccaaaaggggaaacacacagcgccgccccgcgcgaataacaaccaagcaaaaaaccgacgaaagaacgcagaaacatac

SEQ ID NO: 38857 - DNA, 1652 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagaaggtcgacgcagagcagaaggtcgacgcagagcagaaggtcgacgcagagcagaaggtcgacgcgagcagaagacgacg

SEQ ID NO: 38858 - DNA, 914 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaataaaaggaaaaaaaaaatggatg

SEQ ID NO: 38859 - DNA, 1069 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaagcctatcatatagtaaaacccagccatgaccctaacagggccctctcagacctcctaatgactccggctagcatgtgatttcacttccatccataagctctcaaattaggctaataacaaagataacattacatgatggcgatgtaccgaaaagatccaggcccacccgtcaaggtcg

SEQ ID NO: 38860 - DNA, 1015 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaccaggacacacaacaaaaaaaaaaatcgggggacctttcggggggacacacgagttaggccgggctagttccggcccccttttgtgcacagggaatgcggcccaaagggggtattgaacgcggc

SEQ ID NO: 38861 - DNA, 1686 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagggtaaataagtagttgctcggttttgtttgtgatagtagaaagatttgtggttgctgtgatgactatcttaggacacctttggaataactatgaaagaaaactattctgagcaacccttttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgggtatctgtagtcccagctactcaggaggctgaggcaggagaatggcatgaacccgggaggaggaactaggagtgagccgagatcgcgccactgcactccagcctgggtgacagagcgagacgctgtctcaaaaaaaaaaaaaactggtagttttatattcagtacctcaggcccgtatgattatctgctgatggccccacttagatgtacatagccacttcaaaatgggccctctccccaaatctaagaagcttgttttcagtaattgatcacatttagttcttttaagtcaagaacctgagtgattctgtacacttctttttacatctaatgaacttaagttctgttgatttctaccatttaagtatttttcccccttagtccttaacgactaggtttcctgcctccagaataagctgaagtcctccaagatgtactgtggttttctctaagaaacttaacacatttttctttccccagatatcccagaagaaactgaagaaacaaaaacttatggcacgggagtaaattcagcattaaaataaatgtaattaaa

SEQ ID NO: 38862 - DNA, 1632 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagggtaaataagtagttgctcggttttgtttgtgatagtagaaagatttgtggttgctgtgatgactatcttaggacacctttggaataactatgaaagaaaactattctgagcaacccttttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgggtatctgtagtcccagctactcaggaggctgaggcaggagaatggcatgaacccgggaggaggaactaggagtgagccgagatcgcgccactgcactccagcctgggtgacagagcgagacgctgtctcaaaaaaaaaagccccacttagatgtacatagccacttcaaaatgggccctctccccaaatctaagaagcttgttttcagtaattgatcacatttagttcttttaagtcaagaacctgagtgattctgtacacttctttttacatctaatgaacttaagttctgttgatttctaccatttaagtatttttcccccttagtccttaacgactaggtttcctgcctccagaataagctgaagtcctccaagatgtactgtggttttctctaagaaacttaacacatttttctttccccagatatcccagaagaaactgaagaaacaaaaacttatggcacgggagtaaattcagcattaaaataaatgtaattaaa

SEQ ID NO: 38863 - DNA, 1275 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccaggatggtgttactgcagttgaaagggcaatctgaagttactttcttaatgtgacctagcaataggcatagctacgtggcactatattctggccagactcgatgtgtactctaacttaagaaataaatcagtaaggcagaacaa

SEQ ID NO: 38864 - DNA, 1990 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggtgagaattcttagttgccatttgaaaagacagattttaatggaaaagtgatgggataggataagaatggctaagatctgtgctgatgaacctatttctggttgctgtaatgacaggacaccttggattgatggtgaaataaaccatatcctaagaaaccgtgatatcagataaattcatcttggctgtaatgttaatttaaatcaaggaaaatgactcatcatctccattttctttcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38865 - DNA, 848 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagataccaccgggaaacaaacgcttt

SEQ ID NO: 38866 - DNA, 1572 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38867 - DNA, 1918 bp, Homo sapiens
  misc_feature (2)..(3): n is a, c, g, or t
tnngctagtagagccggtggttgaatcggccgagggcagcctgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggtgagaattcttagttgccatttgaaaagacagattttaatggaaaagtgatgggataggataagaatggctaagatctgtgctgatgaacctatttctggttgctgtaatgacaggacaccttggattgatggtgaaataaaccatatcctaagaaaccgtgatatcagataaattcatcttggctgtaatgttaatttaaatcaaggaaaatgactcatcatctccattttctttcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38868 - DNA, 1803 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaaggtatgcgattcatagttgtgatccaacagttcctcatgttccactcaaaaaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38869 - DNA, 742 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38870 - DNA, 1637 bp, Homo sapiens
  misc_feature (2)..(3): n is a, c, g, or t
tnngctagtagagccggtggttgaatcggccgagggcagcctgagtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagggtaaataagtagttgctcggttttgtttgtgatagtagaaagatttgtggttgctgtgatgactatcttaggacacctttggaataactatgaaagaaaactattctgagcaacccttttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgggtatctgtagtcccagctactcaggaggctgaggcaggagaatggcatgaacccgggaggaggaactaggagtgagccgagatcgcgccactgcactccagcctgggtgacagagcgagacgctgtctcaaaaaaaaaaaaaactggtagttttatattcagtacctcaggcccgtatgattatctgctgatggccccacttagatgtacatagccacttcaaaatgggccctctccccaaatctaagaagcttgttttcagtaattgatcacatttagttcttttaagtcaagaacctgagtgattctgtacacttctttttacatctaatgaacttaagttctgttgatttctaccatttaagtatttttcccccttagtccttaacgactaggtttcctgcctccagaataagctgaagtcctccaagatgtactgtggttttctctaagaaacttaacacatttttctttccccagatatcccagaagaaactgaagaaacaaaaacttatggcacgggagtaaattcagcattaaaataaatgtaattaaataaaaggaaaaaaaaaatggatg

SEQ ID NO: 38871 - DNA, 669 bp, Homo sapiens
  misc_feature (2)..(3): n is a, c, g, or t
  misc_feature (608)..(608): n is a, c, g, or t
  misc_feature (615)..(615): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaccgagaggtatnctgactnaggttgagtgagtcctcggcatagcatcccagtaccaagccctagtcgccccga

SEQ ID NO: 38872 - DNA, 866 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaccaggacacacaacaaaaaaaaaaatcgggggacctttcggggggacacacgagttaggccgggctagttccggcccccttttgtgcacagggaatgcggcccaaagggggtattgaacgcggc

SEQ ID NO: 38873 - DNA, 796 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38874 - DNA, 491 bp, Homo sapiens
  misc_feature (2)..(3): n is a, c, g, or t
  misc_feature (430)..(430): n is a, c, g, or t
  misc_feature (437)..(437): n is a, c, g, or t
tnngctagtagagccggtggttgaatcggccgagggcagcctgagggttgactggattggtgaggcccgtgtggctacttctgtggaagcagtgctgtagttactggaagataaaaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaccgagaggtatnctgactnaggttgagtgagtcctcggcatagcatcccagtaccaagccctagtcgccccga

SEQ ID NO: 38875 - DNA, 789 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaa

SEQ ID NO: 38876 - DNA, 295 bp, Homo sapiens
gtaagtggacaggaggtagatacccatttcctacttggggcttggcataagataccaaaaattaaccaaaacgttttatttcctagcatgcaaatcaagaggttccaatcttcgtgttcactttaaggtatgcgattcatagttgtgatccaacagttcctcatgttccactcaaaaaaggtagctgcagtgatgactttcttaggacacctttggatttaccgtgaaaattaataaattctgagcagccaccttatatttaggcattgatgatcagggtgtaaggatgtagcgt

SEQ ID NO: 38877 - DNA, 451 bp, Homo sapiens
tccagttctgctctggatctacaaaaaattcctggagccatatatataccctctggtttcccccttcgttagtcgtatatggcctaagaaagcaatacaagaatccaatgatacaaacaaaggcaaagtaaactttaaggtaagaacattcacatgccttgaataagagcagtgaaagggggtggtacttgggtgaaacactagattttggaaggacaagttttagaaccagaagcttcaatagtttgtgtaacatttggcttaaattaaagttttaaagtaggcctctgattaatgcatttgtcctttggccaaaatgataaccatattttctgactggtaagtgcaatggtaaatagctaatggatgaggagagattatgctgatacaaaccagtttcactgattgatgactttgataagagatttaattagaaggatcatagagattt

SEQ ID NO: 38878 - DNA, 628 bp, Homo sapiens
ggccggggcctctttccctaagcagcctgtggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactggagaaacacatcacttatccatgataatctgtctaccctgttggccgccttgccccaac

SEQ ID NO: 38879 - DNA, 469 bp, Homo sapiens
ccgctccaacatcagaatggtaacgaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaataaaaggaaaaaaaaaatggatg

SEQ ID NO: 38880 - DNA, 932 bp, Homo sapiens
gtggctgatctagaggatcccagaggctgaagcggctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaacaaaaaaaagtctccccaggctggatccg

SEQ ID NO: 38881 - DNA, 912 bp, Homo sapiens
taaaggctaggtacgaggctgtgtttctcctgcgttgctccgagggcccaatcctcctgccatcgccgccatcctggcttcgggggcgccggcctccaggcccccgggaggagaactcctagggctactaaatcctcgctggaggcggtggcttcttatgcgggaggacgtggcggagggcctgactttgggagccggggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaccccgacccaccacacacaaaaaaaagccgcggccttttgtgggggggcaaaagggttggggggccggataggggttgcccccttcgccagggaaggggcgcccagggggaaagaac

SEQ ID NO: 38882 - DNA, 824 bp, Homo sapiens
taggctagtacgaggcggggtgtgaatcggccgaggctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaaaccaaacaaaacaaaacaaaaaaaaccccggagggcctctaattgcgggggcgcgggaaaacgggtttttgaatggccccctgggctcaaaacgtggttcccggacccagttttcttgcccagggggaaattggcgggcccctaatagggggccgataattccagaacccggtacg

SEQ ID NO: 38883 - DNA, 925 bp, Homo sapiens
  misc_feature (657)..(657): n is a, c, g, or t
gtggctgatctagaggatcccagaggctgaagcggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaaanaaaagaaaaaaaaaaaaaaaaaaaaaaaaagaagcaccaggaaaacaacagaagcgcaaaaaacaaaccataaagcaaaaagcaaaaagacaaaaaaaaacaacagaacacaacacaacaaaaacgaacaaaccaaacaacagagagcacacacaacacggggaagacaaccgcacaaacaagacaacaccaaaaggggaaacacacagcgccgccccgcgcgaataacaaccaagcaaaaaaccgacgaaagaacgcagaaacatac

SEQ ID NO: 38884 - DNA, 1838 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaaaaaaaaataaaaacctgaggggggcccgtacccaattgcctaatggagccgtatacaattactggccgcggttacaacttgtgactgg

SEQ ID NO: 38885 - DNA, 1825 bp, Homo sapiens
  misc_feature (2)..(3): n is a, c, g, or t
  misc_feature (1761)..(1761): n is a, c, g, or t
  misc_feature (1791)..(1791): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaaaaaaaaaatanaaatagacacacagccatctgtcacttcgngcttatcgatgacgcacatataaaaaaacaaaaa

SEQ ID NO: 38886 - DNA, 940 bp, Homo sapiens
  misc_feature (2)..(3): n is a, c, g, or t
  misc_feature (906)..(906): n is a, c, g, or t
  misc_feature (917)..(917): n is a, c, g, or t
  misc_feature (922)..(922): n is a, c, g, or t
  misc_feature (926)..(926): n is a, c, g, or t
  misc_feature (928)..(928): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaacaacacaacaaacancaaaacaaganacaanaaananaacaagaggggg

SEQ ID NO: 38887 - DNA, 920 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaacaaaaaaaagtctccccaggctggatccg

SEQ ID NO: 38888 - DNA, 1697 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38889 - DNA, 972 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatccagaagaaatgagaacaaaacttatggccgggagtaaatcagcttaataatgtttagggaaaaaaaaatccgggttctttcgggggaaaggttaagggcggttgttccgccccttgtaagggaatgcggccaaggggtatgaagtcggaaga

SEQ ID NO: 38890 - DNA, 1632 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagggtaaataagtagttgctcggttttgtttgtgatagtagaaagatttgtggttgctgtgatgactatcttaggacacctttggaataactatgaaagaaaactattctgagcaacccttttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgggtatctgtagtcccagctactcaggaggctgaggcaggagaatggcatgaacccgggaggaggaactaggagtgagccgagatcgcgccactgcactccagcctgggtgacagagcgagacgctgtctcaaaaaaaaaaaaaactggtagttttatattcagtacctcaggcccgtatgattatctgctgatggccccacttagatgtacatagccacttcttagttcttttaagtcaagaacctgagtgattctgtacacttctttttacatctaatgaacttaagttctgttgatttctaccatttaagtatttttcccccttagtccttaacgactaggtttcctgcctccagaataagctgaagtcctccaagatgtactgtggttttctctaagaaacttaacacatttttctttccccagatatcccagaagaaactgaagaaacaaaaacttatggcacgggagtaaattcagcattaaaataaatgtaattaaa

SEQ ID NO: 38891 - DNA, 971 bp, Homo sapiens
  misc_feature (2)..(3): n is a, c, g, or t
  misc_feature (827)..(827): n is a, c, g, or t
  misc_feature (840)..(840): n is a, c, g, or t
  misc_feature (842)..(842): n is a, c, g, or t
  misc_feature (851)..(851): n is a, c, g, or t
  misc_feature (859)..(859): n is a, c, g, or t
  misc_feature (861)..(861): n is a, c, g, or t
  misc_feature (865)..(865): n is a, c, g, or t
  misc_feature (870)..(870): n is a, c, g, or t
  misc_feature (877)..(877): n is a, c, g, or t
  misc_feature (889)..(890): n is a, c, g, or t
  misc_feature (893)..(893): n is a, c, g, or t
  misc_feature (903)..(903): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagattccagagaantgaagaacaaaantntggccggantaatcgcntnaatnatgtnttacaanaaaaaaaccggnnctntcgggggggnaaaggttctaagggctgccacgttcgacctttgtaaaggggaatggcggccaagaggaaatgaacgcg

SEQ ID NO: 38892 - DNA, 1601 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtagtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38893 - DNA, 1655 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38894 - DNA, 1697 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaa

SEQ ID NO: 38895 - DNA, 857 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctagggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaaggttacccaaaccactaacatcctgtgcaacttgggtggttgtttaattaatgttggctgttcagatttatgtccttgattttcttgttttcagtaattaactcatttaggattttttaaatttctacctgcagtttccacagaatgaaactatttccttttattttttttgagtccctttatggcaaaattctgtgaagatccagaagcgtgctctgtggtctctttaagccta

SEQ ID NO: 38896 - DNA, 829 bp, Homo sapiens
  misc_feature (2)..(3): n is a, c, g, or t
tnngctagtagagccggtggttgaatcggccgagggcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaatgtcttaccagggaacaccatccacaacaaact

SEQ ID NO: 38897 - DNA, 395 bp, Homo sapiens
cacattgtgcacatgtaccctaaaacttaaagtgtaaaaaaaaaaaaaagaatggtctgtgcttatagcagggtggaaaacttacctttttcctccttatcagtcagtttaaggaaccaaccgtaaggggcatttctgaagggctgcatttgcactgagtctgcccacatatgtgtcccagtggcaccaccttctcaccgtgtctacttgctttttcttctgttccagattgtacaaaaatatgatatcccacaacctgttgtatcctcatggtaattttcccttctgtaaccacttctcctttggagccctcctattaccagctcagtgtagctctgcccaagcctaatcttcccagatgataggttggtctccagtccaaccccctaaataaa

SEQ ID NO: 38898 - DNA, 373 bp, Homo sapiens
atgcaaaaaccatgaatcacaatcatgatatagacataaacagttcattccttttatatgtattttccaaatatatattacatatatttacatataatatagaaatgcatatataaattatatatgaataaaattatatgtatttatataaatatgtatttatatatcaatacatatatatgtatataaaaacatgaatcaatctcaaaaccattatgttacggtaaagaaaccagacacagaagtctacatactatatggttccatttatacaaaatgttttatttttatttatttatttattttttgagatggagcttcgttcggtcacccaggctggagtacaatggtgcaatctcaactcactgcaacc

SEQ ID NO: 38899 - DNA, 461 bp, Homo sapiens
aaggccaattacatttgttgttttcaatagaatgattatttgaacatttccttgatgatttattatttcatatctatgttaggtttttatagtccccctcccaccctcacccccagaattctgaagagttagttggaagaaggaagaaggcaccattttaggaatattttattccagtttattgaatacagcctcctaaattgaggattagcgacagtaataaagaaaaaaaaagacctttagaaaattagaacattaagggtgaaatcagtttcatccagtcctggggaaaaattcctgttcctctgatcctgggttagttagcctgctttcaaagttatctacttctggagcaaggactcttggagcctaccttggcctctggcagtgtctggtcaagaagaggatgtcaacgtggcagcctgtatgcatttgtcttttctagctcaaagcagaggcct

SEQ ID NO: 38900 - DNA, 832 bp, Homo sapiens
agagaaagacaaaaagggcacagagaagcagagagaactgtatatatacacatacattctggacttcaggaggaagagatgtactgcctaactgttctctccctgacacattctctaaggcatccaggtatacacacagctgcatcgtgtcactgcaagcggctcccagagttgttcctgttcatccaggaagaaagaaaatcccgccaaagattgagagagatcaataaatgtatttccaaagaacctgaaagaagatgtttccatttggctgtcttaccctctatccaagctcagagggaaatgcattcaagaacgttaacggccagcacaaattccattccaagccatggagcgggaagggcacatgataccaagtgtcccaccagacggccatcttgctaactaatacacctcgggattacatttgcatttacacaaaatgtgagctttgggagccagacgtattattttggttaatagtttggcacgttctcagcttggaagcctgagcatatgtgatgggtcagtaacacaataaaagtaacggggaagcatttctttccccagtggtgaatttctaccctattcaggaaacagacttcccaactcagccattacagctgtctggatcgttcataccatttgctgttaaatatacccaagtaggaaaaacagtgtctttgtatttgctgttaaatgtaatcagagacaatctttacggtcattcgggatcattactatcagcataattactgctttagagaacaataatcatacatatgtgtggtatagatatgcggggagtccaatgcagaaatgcagaagagac

SEQ ID NO: 38901 - DNA, 1160 bp, Homo sapiens
tcacttctttctacttacttgctgtgcttctctgagtgcctcgtggcctctttatcaccacctgttgaaggaaatgttagatccagatatggatggaaggtattatgtgacacgggaactttcagaaaatgaagacccaaaggaacaggagatctgtggattttcatggacagtcatctgtggattttcaaggacagtcatgcagaagcatacttggagaacagggattatcttgaggttctaggggctaagtgcatgtttgagtgaaagctgtaagagagctaatgagcacagaatctagaaaaaaaaatagatgtaaccagacataaaggaaattcaaatgaattctgaattcgaggttgaaattggtctaaggaacaatatttagctttgaaggtgaatttcagcattgccttcccttttgctgaatttgcagtttcccatatggcatccaggtatacacacagctgcatcgtgtcactgcaagcggctcccagagttgttcctgttcatccaggaagaaagaaaatcccgccaaagattgagagagatcaataaatgtatttccaaagaacctgaaagaagatgtttccatttggctgtcttaccctctatccaagctcagagggaaatgcattcaagaacgttaacggccagcacaaattccattccaagccatggagcgggaagggcacatgataccaagtgtcccaccagacggccatcttgctaactaatacacctcgggattacatttgcatttacacaaaatgtgagctttgggagccagacgtattattttggttaatagtttggcacgttctcagcttggaagcctgagcatatgtgatgggtcagtaacacaataaaagtaacggggaagcatttctttccccagtggtgaatttctaccctattcaggaaacagacttcccaactcagccattacagctgtctggatcgttcataccatttgctgttaaatatacccaagtaggaaaaacagtgtctttgtatttgctgttaaatgtaatcagagacaatctttacggtcattcgggatcattactatcagcataattactgctttagagaacaataatcatacatatgtgtggtatagatatgcggggagtccaatgcagaaatgcagaagagac

SEQ ID NO: 38902 - DNA, 311 bp, Homo sapiens
tcgcccaggagcttattagaggtgaagactctcaagtcccaaccctggcccactgagtcagtctgttattttaacaaaattcctgggtgatttgtgggcatcgtgatgtttgagaagtgctgatcatcttcttcattatcatccttactgtcctttaacttatcagcagaaacatgagacagcaggtccaattcaactccaataaactctcttctatttgtatttacactgaatttgttgaaggggtgtaaaggtaatgtttccctggtcaattccagaaatcctggaaaatattttgggaaaggatttaa

SEQ ID NO: 38903 - DNA, 390 bp, Homo sapiens
agtgagccaagattgtaccactgtactccagcctgggagacagagggagaccttgtcttaactaaaacaaaacaaaaataaagattttttttctttttaaactaaattctgttgtctcagaatggaatggcatactgttatctgacctggccagaagctctgattggtagttatgaatccctttgaattattaaaaaaattaggcaaattagtgcatttgctgggtaggagaggtttttcaagatctaatatgtgagagagaaagtgaaaactaaaggaattcttggagatcaggaagtggagaatctctggcctgtggcgctgctgagcctaacttcctggcttcacatcagcagtggaggcttccctgggaggtgttcttgcagtttg

SEQ ID NO: 38904 - DNA, 1072 bp, Homo sapiens
ctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaacgcctggcccagccgctccactctgctccccgccgcttcgtcgccaggagcgggcggcgcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccccggagcgcaggcggcggctcgggcgggaagaggcgctgggcggccggactcgcagaggggcgtgcgcggagctgggcgcggggcagcggccaagagcctcagcgccctttcatctgacactggggacagacacaatccagactcctcagcagctcgggaactccggagggaacggcgcgcgctctctacccctctcgctctcctctttttttcttccctctctcctcctcctctctctccctgaagcctataaaatgtttgaaggaaagggggcagtcaagaaaaatctcccgcttccctccttctctccctctctccctctccccgctcctgtctactttctgtatctgtgactctatctccctcctccccctctcattctcctcccgggatcaagccaaaggctcggagattccatgacaccagaaccccgcgtctgtcaggctgtcaacattcccgcagcaagcgcaccagcgccgaaagccctgattgatcccatatgtctggcaggagctgcagaggaattcactggagatggatccagataccgagagtgc

SEQ ID NO: 38905 - DNA, 1237 bp, Homo sapiens
caggctccaagcttctccctctagttattctctctctcttttccccagaactgagtttcttgagttagcatattcactttctacttcctttcctcccacttatcctcagttcacctccatgctatgaaagcagtttttcaaaattacatgatctactggttcctaaatttgaaggactttagttcatatactaggactcctctctcctgattctctggttgcttctgatgtgtggtctccttacttcttcctcaccaatccctttatacattggtgagccctgaggatctgcttcagttccgttttcattccacttcttctccctgagtgatttcatttattcccgttgcatcagctgctgcctatttaccgaggaccctcaagacctggctgctttggacccttccttctttatgaaaagcaccgggcctttagtctttaatttctgaaatatatttatttagttctctatggtctgtaacccttctgaaataagaacaatgagaattgatatcctttcggtagaaattaaaatactgaagttcagagggttaagtgatttgcccaagaatatgtggttagaaaatggcagagctaggccgggtgcagtggctcatgcctataatcccagcactttgggaggcataggtgtgcagatgacttgaggtcaggagttcgacaccagcctggccaacatggtaaaaccccatctctactaaaaatacaaaaattagccaggcgtggtggtgggtactctgtccatcattccagctatatgggaggctgaggcaggagaattgcttgaactcaggaggcagacgttgcaatgagccaagatcatgccactgcactccactctagcctaggcaacagagcaagacttttgtctcagaaagaaaaaaaaaaaaatggcagagctaaaattagtgctttctgacataaactataggccaaaatttccagttctctgttagctcaaaacccttctactatatatttggtccattctttcactcttaggtaatcgtgggatctcagctttcaccagaacccctgatttattggacaacatgaacaaattggagtacttagccattctattacttttcggggttgagattataatttttcagggtgtccatgggactaaaatgagcatgagtgggagcacggtttctcaaccttccaaccttcattatcccggcctctaaggagaaaaactaaatttaaattctcc

SEQ ID NO: 38906 - DNA, 821 bp, Homo sapiens
caggctccaagcttctccctctagttattctctctctcttttccccagaactgagtttcttgagttagcatattcactttctacttcctttcctcccacttatcctcagttcacctccatgctatgaaagcagtttttcaaaattacatgatctactggttcctaaatttgaaggactttagttcatatactaggactcctctctcctgattctctggttgcttctgatgtgtggtctccttacttcttcctcaccaatccctttatacattggtgagccctgaggatctgcttcagttccgttttcattccacttcttctccctgagtgatttcatttattcccgttgcatcagctgctgcctatttaccgaggaccctcaagacctggctgctttggacccttccttctttatgaaaagcaccgggcctttagtctttaatttctgaaatatatttatttagttctctatggtctgtaacccttctgaaataagaacaatgagaattgatatcctttcggtagaaattaaaatactgaagttcagagggttaagtgatttgcccaagaatatgtggttagaaaatggcagagctaggccgggtgcagtggctcatgcctataatcccagcactttgggaggcataggtgtgcagatgacttgaggtcaggagttcgacaccagcctggccaacatggtaaaaccccatctctactaaaaatacaaaaattagccaggcgtggtggtgggtactctgtccatcattctcctgcctcagcctcccaagtagctggaattacaggtacccaccaccacgcct

SEQ ID NO: 38907 - DNA, 432 bp, Homo sapiens
gaaaagagcctgggagggctccattcctttcccagcaagaaaggtgacgagggacaacagcaggagcacggaggaaatcatgtcttattaaccaagtgtactccaaattccagtaaaattcccagatataattaaggtgtttcctgcagtttaaatgacaagttaggctgaaagaggacagttaaatgtagagaataaatccccattcagcatctttagctgtacttgagcttgagattctaacctttctcccatggcaccttctctctgtgacttcagagtgtgtgtctatgtgtgggtgtgtgtgactaacaagatattattaatctggaaaggcaggcttcatctaatctaagcactccatcaccttccttcttcggttaacatcatacactatacacagttgaatcatgatcttgcccaaaatgtcac

SEQ ID NO: 38908 - DNA, 1223 bp, Homo sapiens
ataaatatttgttgaatgaaagtctgtacattgtatttatgctattggtattgctatgacctgaaactaaaaggagttgtggaaaagatttcttatggaacagaaatatcccttttgattaatatcacaatctcgtaaattgagaaaacaaaaaaatatatactactggagcattcatgtatagttggagattatgactcatttattggtgtgtttttggactcagaacaaagatgagggaatattccttaaagctctgtattgaaataacgaaaagcagtcacattttaataatagaagcttcctagcttactctttctgtaatcttcttttcctaaatgtaagagagcctcataattatgaggcttattactagagtaaggctgtcaaaggcagcaaaatgtctttctgtttggaagaataacataaacttgacatgtatggtgggggacagaaggtttcaaaagtttaagaatctgtgttgtcttaacaaatagatgcttctcaaggagcttacgctagtggttactctgtccagtcagggttttttcttctttaacttgggttcatttcctgatggcacacatgaagtttggatcatatggtttgactttagctatggtccttagctatggggagcagcatcagcgacctgtgacatgtaaattaaaaatacaatgccagggcccttccccagcccctctgatagagaacctcttggccatctgtatttttagatgttccaggttagtctgattaacacccttggttaagaaccattgggaggatctgattgccagtttaaggggaccttcaagcctgtaggtctttatagttaaaaaaaaaaaaagattttaaaaatcatgcatatgttgtggctgaattctggtttagcacatactgcttttaatggcctgaaatgtttttcccaaataaattgtcttgttatagctttcatgtgtgatttggtccagcttcttgttttgaagatacttacgggggggaacactttgtgatttctcttagtaacatattaacccacttaaaaaccctttctattacaggtcttcacatttaggcttaatgtgcttaattcaaatgtaaaaatacacctgcctttgttctcagtgaaagtatgtaataaataaatgaggggttggcaaactactgcccaccatctgtttttttatggcctatgaactaagaatcgttttggatagcta

SEQ ID NO: 38909 - DNA, 530 bp, Homo sapiens
agaaaaaatacatcattttctgtctgcaagatttttgtgcataatatttgtcacggaaaaactataccaatgaatggttcaaatgcattttgcatttgttaccaaacaatactggaaagtttgagatttctgttccattcaacccacagtacagtcttcccagcaagaagaacatgagtattccctccatctgggtcaagattagaggctgctttgaaggagcaaggaaaaatgtggactgttcccaagtatcactgacttttctgcttagcatggaaaaatgtgtcacttgagtgttttccttttctttccaagttttatttatttgaactcaacattatagcagctacaaaagaaattattataaagattaatgacccacaatttaatcacttggacacaactgttttcttcctatatttctttccattccttatctaaatgggaaattattttatacaattgtaattacagtatagatgatactttaaacatttaaacattacattaaagacaattttctaaatttc

SEQ ID NO: 38910 - DNA, 465 bp, Homo sapiens
tcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaaggaaaaagataagttgcttgaaagtcccatctcttttgctagtcggcttctgtctgataaaattttattctggttttgcttcattgtttattcattcagtagatgttcattgaacacttactgttaccaggcact

SEQ ID NO: 38911 - DNA, 343 bp, Homo sapiens
caaggccaagagcgtctggggtagcaaaccaactctcttgtgattggatttatcttaaaaattgataggtaacttttgcccctcacaacagatagcagtccaccttctgtttcatactatgtgtaactccatagccacctaggtaccagagttttatcttttcctttcgtctctttctttttccccagcaatatttaactatattctaatgcatcagggttgttctagtgaatctcattgctgccactgctaagtcatgagtccccaagaccaccctcacattcagagattcactagaaggactcgtcagactccacacgttgatacactcatgacggagact

SEQ ID NO: 38912 - DNA, 243 bp, Homo sapiens
gaccaacgtgctcatcatacacatgtgcttattatacacaatgcacagatactacagtccatctttaaatatgtctaattggaaactggaaggctgactggacatgagattatatgaagagattgtttcattttagaacagagaagggtttggtcatgagaatttggtgacgcaccaggcacggtagctcatacctgtgaggccaagtactttgggaagctgaggcggagaattgtctgagcc

SEQ ID NO: 38913 - DNA, 949 bp, Homo sapiens
agtattgatctttcactgccatgcagggatgagctgtccagatgataaattaagacaatgagaacataagggattggcttcaagatttgtggttgccgacggaatttcttcagcagaaagagaaggaaactgaactacggaactggtaggatattattatttttactgtaaacgatccaagcctgtcaggcctgtaacttccaagtgcaatgtattatgatctacagtgtaaaacaaaagattctgaatttgagtcagtaatagctggtttattccaggattcaaatgtaagtaacttactctcaccaacagtagtcaaaatgagaagcctgctatgctgtggatttatggctcatggactctggatgagttctgcatttatcttcgtggagtgacgaataattgaattggaaaatcatggcatccagaatggaactgcataaaaatctgctggagtgtttccgaaaaaatgaagacctctgggcccttatcccagactttctatttcagtggtccatggaagagcctgcaagcttggcttttccatctcaggacttagctgcagggtctcagggcacactgcagagactcgtcatcctgttgcctggaggtgtgcactggctatttgcagatgagccgccatcccgatgactgcccaatcctcggctgcctgtgctccgggtctccattcatttgaccagcaagacccacatccagcagcaaggactccaccgggatgggagcctggtgcttattctcgaactcagcaatccagcagtgcacctgggtctgtttccagcctggccaatgatattctaagcatgaattattacatattactaattattaaaaattaaatgtaaaaaaaaaaaaaacaaaataaacacagcaacacacaacaccctgcaaacaagaaaacaacaaaaaaacaaaagacggagggcggcgc

SEQ ID NO: 38914 - DNA, 422 bp, Homo sapiens
agcacgagttttcattaaaaataatatttattttaacgtttactctagcatatattactgtaaaaaacttttgtgatgtaacaaactgggaaagagctaatgatttaattaaaaagtaggacatcggccgggcgcggtggctcacgcctgtaatcccagcactttgggaggccgaggcgggtggatcatgaggtcaggagatcgagaccatcctggctaacaaggtgaaaccccgtctctactaaaaaaatacaaaaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaa

SEQ ID NO: 38915 - DNA, 471 bp, Homo sapiens
ccaaggaagaaagtttatttgggtgctacagccaaggggaacaggacataagtctcaaatctgtgtctctggcctactaaaattagggatttttatagcagggaagaaatgtaaccatgtgtgggaaacaggaattagggaggggtgaggaagaggagctggtcaacaggaagcggggggttggttaggcatcatggtgggtaaggggtctggtaagcttcaggttttgtttttgttttttgagacagggtcttgctctgttgcccaggctggagtgagaccttgtctcaaaaaataccattttttaatttaaaatttaaaaattttaaaaattaaaagtccagacaactgcagggctttgggcgatcccttttctttcagagccatttcctcctcagtgatatggaactatgcatcctcaggcagtatgcaggtggcacagggctgtgtgtctgtaagcacttaataaaa

SEQ ID NO: 38916 - DNA, 367 bp, Homo sapiens
ttttttttgagatggagtctcactctgtcacccaggctggagtgcagtctcatgatctcagctcactgcaacctccacctcctgggttcaagcaatcctccctcttcggcctcccaagtagctgggattacaggtgtgtgccaccatgtccagctaatttttttgtatttttagtcgagacggggtttcgtcatgttggccaggctggtctcgaactcctgacctcaaatgatctgccagtctcagcctgccaaagtgctgggattacaggcgtgagccaccgttcccagcgcaaaagtatgattttatatgaggttacaatctgttatccataattctgaagtccaaaaagtttgaaaaatgttat

SEQ ID NO: 38917 - DNA, 461 bp, Homo sapiens
atatttttagtggagatggggttttgcatgttgcccaggctggtctcgaactcctgggctcaagctgtccaccctccttggccttgtaaagtgctggtattacaagcatgagccaccacacctggcccctttttgttctttttaatagtacgtcagcttttttcctggtcattgaaaattcctcaaggatgtctttaatttacatcttaaaatgtaggctggacgcagtggcccacacctgtgatcccagcactttgggaagccgaggtgggtggatcatctgatgtcaggaattcaagaccaccctggccaacaatggtgaaaccctgtctctacaaaaactacaaaaatccatcctggccaacgtggtgaaaccctgtctctacaaaaaatacaaaaattagccaggcgtggtggcacacacctgtagtcccaactacttgggggctgaggcaggagga

SEQ ID NO: 38918 - DNA, 389 bp, Homo sapiens
cagatgccccttttctgtgaatcagggactggccgtggggaggcctgcttatggggtgcgttggggctgtctgtagggaatgccgtctccctccctcccttgtatttccgctggcttcctctggcatcacattcccaggagatttcaggtcagagaggaaatgcctctgtggatgtactggccatgcattgctctggccccggcactgcatgaggaagtggctgccaggtgtcctccagacccctcccaggaaggggcctcattcggtttcttgggaactgcctgtcttttgttgtgaatggaccacattgtgaccggcctgtgggtcttgtcaggggtttggggccctctgagctgaaatgcttcctgtgggtagagagttgcaggag

SEQ ID NO: 38919 - DNA, 384 bp, Homo sapiens
tcaaatacccctatgtctagttctggtgatatcagtcactaaaaatgggatcagcttgtggcagataccaccttaaatgctcatgtctgtctcagtcactaggaggaaaaccagagcctggaaaccagatccattttgatgaatgtccaagattttgagagtgaaaaactccaaaatgacagctcacagttggcagctaggccagaaggttcccaaggaacatcagaggtattcccggaatataaagaggcaaggccacagaatgactccacatagcagaggtgttgctacgagaggtgacactgtccctgtcagaaacaagtcagtgccaaggagactcaataacaaaaacaactaaacaatcctttcctgcctaacatgagt

SEQ ID NO: 38920 - DNA, 224 bp, Homo sapiens
gctattattgctgagtttttcctaaagaatgggaaatggacttactatgccaaaagaagccaactgaaaaggaaaggtcaaaggaatcaaaaatactcaaaagttcaggagtaaaaagatcatttagccaacccaaaagaataactcttcctatcagacacgaacaaaaataaattttaatgtggtgagaaaggtgtagtaacaagtacaggtgaaggggaaaa

SEQ ID NO: 38921 - DNA, 585 bp, Homo sapiens
ttgtgtaacaacgtgcagggtacttttacttttaattcggggtcctctgatgcagtgattctcaccctcagcataacaaaactgaggctcaaaggatctaatgggtgggctcaggctcctgcaattatagacgggctgaactgagactcgggctctgagcacagacgctggggctacgttccacgggttcaaatctggctctcctgcctgccggctttgtgatcctgagcctcagcattccaatctgcaaagtgggggtgataattgcacctacctcacagggtaggtgtcaggattgaatgggttagtgcacacagagggcttggagtggggctcagggtcagtgccaggaagtgtaaacagttataatggagcctgcgtcccctcactcccaggccagggctcattttactatgcctttgtcccgctctcactcctctctgcctcttctgctcagaaggtgtctgactcagcaaaagtgcccggttatgcctccctctcaagggaactgtcaggcaagcgggtgccctgcttgatccccccggcttggccccggagcctgacatccatctggctgctcccaca

SEQ ID NO: 38922 - DNA, 340 bp, Homo sapiens
cacctaaatccctgcctcaggctctgctttcagtggacctcacataagacactaggattttcttcttcttttttgggtcatattttaactcttcttcccaccccgctcccctaaaattaaaatctatttgtttcttacaaaatttatcctaaatcttccctcactaaccctcaaaactatcatacactgcttcgtaagaaccatttacccatatagcgtaagccagcagaggcatctggctcctttatctggatatcccttttaacccatgaatgcactggtaaattctctaagcatgccgatcaaacagtggtgatcaagagcaaattccatcactgta

SEQ ID NO: 38923 - DNA, 426 bp, Homo sapiens
tctcccacatcacagtaagaattccacacaccatacaacttggaaagaggctccagctgaaggaagccccacacttctttcaagtttttcttagtcttctcttcttggcaaagagtaccttttgtttcttctaattatgtaactattggtttagtaaatattcacccattcagtcaccctgtaagtggcaggcactgtttacagggacacaggaaggaataaaaacttgcaggcaccttggagcttgcattctattgaagaggtaatggaagttgggatagcagctaaactatgctggtattggccaggcgcagtggctcacacctgtaatcccagcactttggaggccaaggtgggcagatcatgaagtcaggagatcgagaccatcctggctaacatggtgaaaccccgtctctactaaaagta

SEQ ID NO: 38924 - DNA, 410 bp, Homo sapiens
agtatagcacatacagttatgtatagtacataatacttggtaataactgtgttacttgtttacatatttactatttatcattattttagaatgtactattacttataacaaattgtggccaggcatggtggctgatgcctgtaatcccaacactttgggaggctgagacgggaggatcagttgagcccaggagcttgagatcatcctgggcaacatagtgagatgccatctttacaagaaaaatacccaaaaaaattagccagacatggtggtgcatgcctgtagtctcagctacttgagaggctgaggcaagaggatcgcttgagccagggagttcaaggttgcagtgagcagtgatcacaccactgcattccaccctggatgagagagtgagacgagaccctgtctca

SEQ ID NO: 38925 - DNA, 379 bp, Homo sapiens
ggttattacattaaattcatctttttagtttaacttcctaactcctttctaggttgtttttagcatccactagctgtgtgctttaaaaaaattccagaaacaagccatttatttatgaataacaaatgaacagaggatgtcttatcagatgggtcactctctggaggagtgcttcagtgaaacatacacacacacacacacacaaccactcatgggcacacaaataaacacatacaaaagctatgatcctactgtctttctcccctaaaggctgtggttaactacaaagttgacattttctgcataataattcaattctgtgcatagctttggggactcacaggctaaatggcattgtgctttgactatggttttgtgt

SEQ ID NO: 38926 - DNA, 397 bp, Homo sapiens
aaacatactgactaaaagacattgtcagagtgggacaagacccatctatttgctatccagaagaaatccactttaaatattatacagaaaggttaaaagtaaaaggattgaaaatgatataccatgtaaacactaataaaacggaagtaactatattcatatctgaggcaaaggaaacttcagagccaggaaagttactaggaatataaggtgtcattacataataataaaagagttcactaagaagacaacaatcctaaatatgtatgtacccacctaagagcctcaaaatgaatgatgcaaaaactaagagaacttaaaagagaaatacggccgggcatgatggctcatgcctgtaatcccagcacttcgagaggccgaggcaggtggattgctt

SEQ ID NO: 38927 - DNA, 447 bp, Homo sapiens
gttcggggtggggagacatttttggtgggaaacgctggcgttccctgctgtttagcaagtggaggggaggtgaaagtgtgtacatactgcctgttttgagggaggaagagtagagtatgtgccacaaagaggagcaggcgaatgcctagagctcagggaggagcacagctacgtccagctgagagcactgaagaggcttgatggagtggtggacacccgagttgggtcttgaagtagggccaggtattgaaggcactcgtcttcaagctgaggtacccatgctcttgaggggacaagggtactccccaagagggacataatacaggtggctttgagggcacaatttccagtccttagtccatctcttcttgtccaactgatcagccaaaagcacacaatgcatgtggtccctgaaatgtggcttctcatctacatctcccattattt

SEQ ID NO: 38928 - DNA, 205 bp, Homo sapiens
taatcccagctactcaggagactgaggcagcagaatcgcttgaacccgggaggcggaggttgtggtgagccgaaatcacgccatcgcactccagcctgggcaacaaaagtgaaactccgtctcagaaaaaacaacaacaacaacaacaacaacaaaaaccccatgtcctttattcaattcagaaaacaattcagtgactcttggg

SEQ ID NO: 38929 - DNA, 426 bp, Homo sapiens
gagagagggtctcgctctgtcacctaggctggagtgcagtagtgtgatcatagctcattgtatcctcagactctcaggctcaaccatcctcctgcctcatccttctgagtggctgggactacaaacatccaccaccacacgcagctaatttttagttttttggtagagatggggtcttgctttgttgcccaggttggtctcaaactcttgggctcaattgatcctcccacctggccccggcctgcatcaaaatttcactcctttaatccctcaccatgttgttgttcacgccatcaaaatgtctccaaactttgattaaaatggtggccaaatctaaaggcacacaagggtgagcttgattccaaatccatagaataatacttttctatcatagccatagccctgtatgtggccctacaataatat

SEQ ID NO: 38930 - DNA, 241 bp, Homo sapiens
tatcggggatgtctgctttctccctgttctaaagctttggtactagaatagtagagtgattaagagtagaggctttgagataaataaacctggcttcaagtctctgctttacaacttactatctgggtcatcttaggaaaatctctgagcttcagtgctttgaatgataaaatacagacaatgataaatgtagggttaggagtagtcattgagataatgtatgcagtgggcagagcacagt

SEQ ID NO: 38931 - DNA, 403 bp, Homo sapiens
agtgatgagctaatcatcttgagtagaggccagtaggagatgcacagaaaccaagagagagtggtaacagaatacaacagtctgtgctcggggcagtatgcagggtgctacaggagaatgtatgagaaaacctgaatccaaagttgcaatggtcaggaaagacttttctggaggaaatgacagcttagttatcacctaagggattagtggaaaccagacaggaattagtcatgagcagcatacccttcttctgtatctataagagcacaaaacttagccatgatggtgtttcaggactattttaaggaaagttttaggacaaatgttggcttcaatacctaatcagtgtgcttgatgtgttagaaaaaaaaaaaagaagtgaaatgaaaagaaaagaaaattt

SEQ ID NO: 38932 - DNA, 1105 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtctgattctctggcctttgtgtccctgggaagttactctgccagaggaaagcaggtgtgctccacttctcccgtgaacctgaagatgagttgtcccagactcttctcagtgattggaaacttaggtggtggagctaaaggttacttgttacgagacttctacagacaactcttgttgggatccatctatggtttagcaacattagtggaaaagttttcttgaatattgactttgaatataaaaacgtttatatttagacttcagattttgtgtgatcatcaaactcaacgaggggataaacataattgggggcgaatgatggtcttgtcttgttaataatttcaacagaagtatcacaacaccgccgactatcctgtccagtcctgactaattccacgcttgttgcatctggatggtagatttgttttaattgtgtattccctccctgcagtagtttgctttagttgtaaacattttttggtcccatgagaaggaaaacatttcaaaaaatagacaactaaagtttctcaaagaaaggaaacctggctgtttgccttcagttgcatgtgtaagtatctagggaacttgatggcagtaatattgcattttggtaggcttgctaagaaaaacctcgtttttataataaggctataatctagcttagacattttaattggtgaagcataaagcttgattagtattaatgcagtggtatgtattgcttttaaaagtcttacaatttctaacaaattaaagttatactgcaattatatcatactttgtgttggtattaactcatgaagtacaaaattttgaaacac

SEQ ID NO: 38933 - DNA, 870 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtttgatttaattttggatgagatcgttcttgcagcaagatgttaataagacaaaatctaggtaagtagaagactgctttgttaaatgtacatatcaaggtaggaataatacaaaaaaattatgtcttaaaaatgtggtgttgagttcagaaccaaagagtttttaaataaaattttgaaatgcaaataattgactttttgacacacttggtccagttgatttgatgggagtaaaattataactatcacattgtggaactaaatttttagtttccttcttttgtgttgaggttaactaaagcattcaagtttccagtgaatattctaaaatgttagaaaatcaagttaatgtttggttcagccactcttattgaactctgaccacttcagtaagacatttattgtgtcacttcattgttctctcctttgttgataaagtatatgaatagtcattgcttttgtgaattttgcttcatttttaatgttaaggaagcactttcccaaatgggataaatttgccaaattgtgatttctttctgttaatatagtattcaaaattgtaaattattgttttaatgttttcctag

SEQ ID NO: 38934 - DNA, 732 bp, Homo sapiens
aacaaaactaaaatacgagtttaacaatggaagacctaggatttgaacggggtagtttaacttgagagtctgctattaaaggcttatgttatactgctctcaacagagtggtaaaataatttagtaaatattaaaataattcagtgaaataacataagaaatactacacaggaaaatacataattacatgtatactcttactttattatactctcacccatttatgtattatactctcacccattttttcctccctctcaggttattctggagcaaacccagacatatttgttatttattgatctccacctcatccccattggtaatttttttctagttttttttttttattatggtaaactatatgtaacatgaaatttgccattttaaccatttttaagtgtacagttgagtgttcctatatacatttataatgtgcactcatcaccaccatccatcttcataactttttgtcttgcgaaactgaaactctgtacccattaaacaacaattcctccgtttctcctgctcctgaggtcctggaaatcaccatttttctctctttgaatttgactaagtgtctcataagcagaatcatatagtgtttgtctttttgtgactggcttatttcacaagtgtgatgttttcacggttcattcatgttacagcattttgcagaatttcctcccattttaagtctgcataatactgtattgtatgtatgtaacacat

SEQ ID NO: 38935 - DNA, 511 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtgagtttcaggggttatttggtcagattcgctgggacccgagtgggtttcgggcctctgggctgtggcagcggcgggactgagggtggcggaagaacttgggggacccggcctccggctctcgggcccggggagctacgccctaggctgggtcccagccatccaaaaggacgcattttgccgcacaggctaagatggcggcggcggccgaggaggcggagttggtgc

SEQ ID NO: 38936 - DNA, 6358 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtctgattctctggcctttgtgtccctgggaagttactctgccagaggaaagcaggtgtgctccacttctcccgtgaacctgaagatgagttgtcccagactcttctcagtgattggaaacttaggtggtggagctaaaggttacttgttacgagacttctacagacaactcttgttgggatccatctatggtttagcaacattagtggaaaagttttcttgaatattgactttgaatataaaaacgtttatatttagacttcagattttgtgtgatcatcaaactcaacgaggggataaacataattgggggcgaatgatggtcttgtcttgttaataatttcaacagaagtatcacaacaccgccgactatcctgtccagtcctgactaattccacgcttgttgcatctggatggtagatttgttttaattgtgtattccctccctgcagtagtttgctttagttgtaaacattttttggtcccatgagaaggaaaacatttcaaaaaatagacaactaaagtttctcaaagaaaggaaacctggctgtttgccttcagttgcatgtgtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtg

SEQ ID NO: 38937 - DNA, 5549 bp, Homo sapiens
aagcttgcggccgcggcggtcgctgggggccacggagcctgaggtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtg

SEQ ID NO: 38938 - DNA, 6118 bp, Homo sapiens
aagcttgcggccgcggcggtcgctgggggccacggagcctgaggtctgattctctggcctttgtgtccctgggaagttactctgccagaggaaagcaggtgtgctccacttctcccgtgaacctgaagatgagttgtcccagactcttctcagtgattggaaacttaggtggtggagctaaaggttacttgttacgagacttctacagacaactcttgttgggatccatctatggtttagcaacattagtggaaaagttttcttgaatattgactttgaatataaaaacgtttatatttagacttcagattttgtgtgatcatcaaactcaacgaggggataaacataattgggggcgaatgatggtcttgtcttgttaataatttcaacagaagtatcacaacaccgccgactatcctgtccagtcctgactaattccacgcttgttgcatctggatggtagatttgttttaattgtgtattccctccctgcagtagtttgctttagttgtaaacattttttggtcccatgagaaggaaaacatttcaaaaaatagacaactaaagtttctcaaagaaaggaaacctggctgtttgccttcagttgcatgtgtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtg

SEQ ID NO: 38939 - DNA, 5499 bp, Homo sapiens
cgcacgatatgacacagcaagttctctgtataccggttgtacaggcaatcaggaactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtg

SEQ ID NO: 38940 - DNA, 2144 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtttgatttaattttggatgagatcgttcttgcagcaagatgttaataagacaaaatctagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtg

SEQ ID NO: 38941 - DNA, 2205 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtttgatttaattttggatgagatcgttcttgcagcaagatgttaataagacaaaatctaggttattctggagcaaacccagacatatttgttatttattgatctccacctcatccccattgccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtg

SEQ ID NO: 38942 - DNA, 1384 bp, Homo sapiens
gagaacagtggtgcactgtttccgctgccctcgtttgtctaattggcccagacgctccaccagcgcgaagcttcccgggagctcctcgctggccacccccgcggcccgcagcccggcagaggcgggaaagcagcgcgcctgcgccgtgggaaccggggctggaggcgaaaagcggggagcggaggggggccgctggagccgagtagcgtacagagcggcgtgtgacgcggggacgccgcgtgctcccaacgtcgccccggtttgacgcacacggcaccaaactgtctgattctctggcctttgtgtccctgggaagttactctgccagaggaaagcaggtgtgctccacttctcccgtgaacctgaagatgagttgtcccagactcttctcagtgattggaaacttaggtggtggagctaaaggttacttgttacgagacttctacagacaactcttgttgggatccatctatggtttagcaacattagtggaaaagttttcttgaatattgactttgaatataaaaacgtttatatttagacttcagattttgtgtgatcatcaaactcaacgaggggataaacataattgggggcgaatgatggtcttgtcttgttaataatttcaacagaagtatcacaacaccgccgactatcctgtccagtcctgactaattccacgcttgttgcatctggatggtagatttgttttaattgtgtattccctccctgcagtagtttgctttagttgtaaacattttttggtcccatgagaaggaaaacatttcaaaaaatagacaactaaagtttctcaaagaaaggaaacctggctgtttgccttcagttgcatgtgtttgatttaattttggatgagatcgttcttgcagcaagatgttaataagacaaaatctaggttattctggagcaaacccagacatatttgttatttattgatctccacctcatccccattggtaatttttttctagttttttttttttattatggtaaactatatgtaacatgaaatttgccattttaaccatttttaagtgtacagttgagtgttcctatatacatttataatgtgcactcatcaccaccatccatcttcataactttttgtcttgcgaaactgaaactctgtacccattaaacaacaattcctccgtttctcctgctcctgaggtcctggaaatcaccatttttctctctttgaatttgactaagtgtctcataagcagaatcatatagtgtttgtctttttgtgactggcttatttcacaagtgtgatgttttcacggttcattcatgttacagcattttgcagaatttcctcccattttaagtctgcataatactgtattgtatgtatgtaacacat

SEQ ID NO: 38943 - DNA, 380 bp, Homo sapiens
ggctgctcggttgtggccagaaacgctggctctggcattaactgtctacacccctccccttacttgggacaggaccgcatagccctcccctccccccgtcctgcaagatcttatgcggctaggtgcctgggaagtaacagcaagaggtaaatcgctcgaagtgtttgggttgccaggggcttggtgggtgtccagctaaagctttttgcctctccaggtctgattctctggcctttgtgtccctgggaagttactctgccagaggaaagcaggtgtgctccacttctcccgtgaacctgaagatgagttgtcccagactcttctcagtgattggaaacttaggtggtggagctaaaggttacttgttacgagacttctac

SEQ ID NO: 38944 - DNA, 865 bp, Homo sapiens
aagcttgcggccgcggcggtcgctgggggccacggagcctgaggtctgattctctggcctttgtgtccctgggaagttactctgccagaggaaagcaggtgtgctccacttctcccgtgaacctgaagatgagttgtcccagactcttctcagtgattggaaacttaggtggtggagctaaaggttacttgttacgagacttctacagacaactcttgttgggatccatctatggtttagcaacattagtggaaaagttttcttgaatattgactttgaatataaaaacgtttatatttagacttcagattttgtgtgatcatcaaactcaacgaggggataaacataattgggggcgaatgatggtcttgtcttgttaataatttcaacagaagtatcacaacaccgccgactatcctgtccagtcctgactaattccacgcttgttgcatctggatggtagatttgttttaattgtgtattccctccctgcagtagtttgctttagttgtaaacattttttggtcccatgagaaggaaaacatttcaaaaaatagacaactaaagtttctcaaagaaaggaaacctggctgtttgccttcagttgcatgtgtaagtatctagggaacttgatggcagtaatattgcattttggtaggcttgctaagaaaaacctcgtttttataataaggctataatctagcttagacattttaattggtgaagcataaagcttgattagtattaatgcagtggtatgtattgcttttaaaagtcttacaatttctaacaaattaaagttatactgcaattatatcatactttgtgttggtattaactcatgaagtacaaaattttgaaacac

SEQ ID NO: 38945 - DNA, 5707 bp, Homo sapiens
gcaatgcactgagtaacggggcgggccgagagcagtcaccaacccctctcgttgaggctgctcggttgtggccagaaacgctggctctggcattaactgtctacacccctccccttacttgggacaggaccgcatagccctcccctccccccgtcctgcaagatcttatgcggctaggtgcctgggaagtaacagcaagaggtttgatttaattttggatgagatcgttcttgcagcaagatgttaataagacaaaatctagactaaatgtgttaaatgggcttgccaacaatatggatgatttgaagataaacaccgatattactggtgctaaagaagaactcctagatgacaacaattttatctcagacaaagagagcggagttcataagccaaaagattgtcaaacatcatttcagaaaaataatacgttgactctgcctgaagaactgtcaaaggacaaatctgaaaacgccttaagtggaggccagtctagtctatttatacatgctggtgctcctactgtttctagtgaaaactttatcttgcctaaaggagctgctgttaatggaccagtttcacactcctccttaactaagacttccaatatgaataaaggcagtgtttcattaaccactggacagcctgtggatcagccaacaacagaatcttgttcaactttgaaggtagcagctgatcttcagctgtctacaccacagaaagcaagtcaacaccaagttttatttttgttatcagatgtagcacatgctaagaatcccacccattccaataaaaaactacctacctctgcttcagttggttgtgacattcagaattcagtagggagtaatataaagtcagatggcactttaataaatcaagtagaggtgggtgaggatggtgaagatttattggtgaaagatgattgtgtcaatacagtaacgggaatttcctcaggtacagatggatttaggtcagaaaatgatacaaactgggatccccaaaaagagttcattcaatttcttatgactaatgaggaaacagtagataaagctccacctcattctaaaataggtctagaaaaaaaaaagaaagcgaaaaatggatgtaagcaagataactcgttataccgaggattgctttagtgattctaattgtgtacccaataaatcaaaaatgcaagaagtagactttctagaacaaaatgaagagctacaagcagtagactcacagaaatatgcattatcaaaagtgaagcctgaatcaactgatgaagacttagaatctgtggatgccttccaacatctaatttataacccagataagtgtggagaagagagttcacctgttcatactagcacttttctttcaaataccttaaaaaagaaatgtgaagagagtgattctgagtcacctgctactttcagtaccgaagagccatcattctacccctgtacaaagtgcaatgtgaattttagggagaagaagcacctccacaggcatatgatgtatcatttagatgggaatagtcactttcgccatcttaatgtcccaaggccatatgcttgtagagaatgtggacggacatttcgagatcgcaattcacttctaaaacatatgattattcaccaggagagaagacagaagttgatggaggaaattcgtgaattgaaagaacttcaggatgaaggaagaagtgcacgattacagtgtcctcagtgtgtgtttggtaccaattgccctaaaacatttgtgcaacatgctaaaacccatgaaaaagataaaaggtactactgctgtgaagagtgtaacttcatggcagtgacagaaaatgaattggaatgccatcgaggcattgcacatggggcagtggtaaaatgccctatggtcacttctgatattgcccagagaaaaacacaaaaaaagactttcatgaaagactctgtagtaggatcatccaaaaaatcagctacctacatatgtaagatgtgtccttttactacttcagccaaaagtgttttaaaaaagcacacggagtacttgcattcatcatcatgtgttgattcatttggtagtcctcttggacttgataaaagaaaaaatgacatccttgaagaacctgtagatagtgatagcactaaaacattaactaaacaacagtcaaccacatttccaaagaactctgctttaaaacaagatgtgaagcgaacatttggatcaacctcacaatcaagtagtttttcaaaaattcataagcggccacacagaatacagaaagctcggaaaagcattgcccaatcaggtgtaaacatgtgcaatcaaaacagctctcctcataagaatgttacaattaaaagcagcgttgaccaaaaacctaagtatttccatcaagcagcaaaagaaaagtctaatgccaaggcaaatagccactatttgtatagacacaaatatgaaaactataggatgatcaaaaaatcaggtgaatcatatcctgtgcatttcaaaaaagaagaagctagttcattaaattctttacacctgttttcatcatcaagtaattctcacaacaattttatttcagaccctcataagcctgacgccaaaaggcctgaaagcttcaaagatcacagacgtgtagctgtaaagagagtaattaaggaatctaagaaggaaagttctgttggaggggaagacttggatagctatccagattttttgcataaaatgactgttgtcgttttgcaaaaacttaattctgctgaaaagaaagatagttatgaaacagaagatgaaagttcctgggataatgttgagttaggagactacactacacaggccatagaagatgaaacctatagtgatattaatcaagagcatgtaaatttattccctttatttaagagcaaagtggaaggtcaggagcctggagaaaatgctactcttagttatgaccaaaacgatggcttttattttgaatactatgaagatactggaagtaacaactttttgcatgagatacatgatcctcagcatttagaaactgcagatgcttcattgtcaaagcatagttctgtttttcattggactgatttgtctcttgagaagaaatcgtgtccttactgcccagcaacatttgaaacaggtgttgggttatcaaatcatgtcagggggcatcttcacagagcaggattaagctatgaagcccgtcatgttgtatcaccagaacaaatagccacaagtgacaaaatgcagcatttcaaaagaactggcacaggaacacctgttaaacgagttagaaaagctatagagaagtctgaaaccacttctgaacacacttgtcagctctgtggtggttggtttgatactaaaattggattatcaaatcatgttagaggccacttgaaaagacttggaaagacgaaatgggatgctcacaaatctccaatctgtgttctgaatgagatgatgcaaaatgaagaaaaatatgaaaaaatcttaaaggcattgaacagtcgtcgtattattcccagaccatttgtagctcaaaaacttgcatcaagtgatgactttatatctcaaaatgttatacctcttgaagcataccgtaatggcctaaagactgaagctctgtcagtgtctgcatcagaagaagaagggctgaatttcttaaatgaatatgatgaaacaaaaccagaactgcccagtgggaaaaagaatcagtctcttacactcatagaacttcttaaaaataaaaggatgggagaagaaaggaattctgctatttctcctcaaaagatccataatcagacagcaagaaagagattcgttcagaaatgcgttcttccattaaatgaggatagtccgttgatgtatcagccacaaaaaatggacttgactatgcactcagccttagattgtaagcaaaagaaatcaaggtcaagatctggaagcaagaagaaaatgctaacattacctcatggtgctgacgaggtttacattctccgatgcaggttttgtggcctagtctttcgaggacccttgtctgttcaggaagactggattaagcacttacaacgacatattgtaaacgctaatcttccacggactggagctggcatggtggaagtcacgtcactacttaaaaagcctgcctccattacagaaacttcattttctctactaatggccgaagcagcttcatagaaccaggaaaccttttaaatagccagtttgaattggatgtaaatttgaaattctttttttttaagccacattaaattatctgtttataaatactaaagcaggaaaatggggggaaagtgaattacagtgacatcagagcaaattgaatacttaaaacagtaagtagtctatatattttatatagggtggaagatgtgtttttaaggtttatgaagttttgttggttaactgtgttcactcagtaaaagagcagtacatgtaagcagccattaataaactgttgcacatggatacttatagacagacttattggacaattatgttttttgcagtgttaccagaatcaaggctctgtttattccccacaagacttgcatagaaaaataagatattatattttgtttgtatgtatttagtgttttgtataataccaagaaccgctgactaaatttactcaaattagggcattaaatatcatgtacttcatagtttgagactgttcactcaaatagggcagagtactattctatctagatgtgtaagtgttttttttaaaatcacatggaacggttttttttatactaaaaagtggagggagatttgtttaaacaagtatttctaaaagaaatatgtacatagttctggaaattatttgtggtaaggaaatattctttactccagttgcatttctcagacaataaagtggtgcatccatgctacctcctactttgtcaacaaagatgctatttaccctttacatttttgtatcataatagattttaaaaatctaatgttctttattgcaagacattcttttgttaacaggtttgtttctttttaatgttttacctaaaatttgacatgcttacaggacaggtttgcctcttactttatttaacattgtagaaatgtaattaataaacaatgctcactacacagtttagaatagacgttctcatttatattatcttccaaatttgatcagttagcaaaacttaatacaccaattaaaatatttctacatatgagaatgtttacaatttaaattttagaacttgttttggatgtgattatatgtacgaaaatcgtgtaacactatgctcatgctaagaaccgacataacagaattactgaaataaatgtgctgtgaggaatggaaaatatggtgcaggtgtcttggtcatgataaattgtgattctttttaaaaattttttccaaaaacaattaggtattttaatctgaaatcagattcctttacaaacaacaagtttttgtatgcaagcaccattttatttcatgtagtatggctaatactatagttgaaccaaggatatgcattgattctttgcttcgtatgtaaataaagttaaaaacagttaaaataaggagtattttggtagagtatatacatacctcactgccagtgaaattgctttcctatggtatatctccttaccagaaaaatctctaaataaaaaaaggtttaaagaaaattaaaatgtg

SEQ ID NO: 38946 - DNA, 996 bp, Homo sapiens
tgtggagagtgagtgagaggagagtgtgttcttacatgcacgtgttcaggctgatggcatgggactgtgacccgtccagtcacacagggtctcaaactccaaggagccccacacctggtttaatgctctgctgttgccctcttgctgatgcccttcttatttttttagagacagggtcttgctctgtcgcccaggctggagtgcagtggcacaatcatcattcactgtagcctcgaactcctgggctcaagtgatcctccccgtttctccccagccccggaagtagctcccaccatacccagctaattttaaaactttttgagagaccaagctggtctcaaattcctgggctccactgggtgcagtggctcatgcctgtaatcccagcactttaggaggccaaggtgggcagatcacctgaggtcaggagttcgagaccagcctggcaaacatggtgaaaccccgtctctactaaaaatacaaaaattagctgggtgtggtggcaagcgcctgtaatcccagctactcaggaggctgaggcacgagaatcgcttaaacccaggaggcggaggttgcagtgagccaagattacactactgcactccagcctgggcaacagagtgagactctatctcaaaaacaaaacaaaacaaacaacaaaaaatgggctggaggagcgggttgtaggcccttccgcctctggtgggtggggagaagcaggggagctggtgttcagctatattctacaaagaaggggtggatcctgagaggcaagggtgggactgaggcctagttacaggtggtcgggaaggaggttgaaggggaactgtgtgaccttggatgttctttgtaattatcttatgcttagctgacacatctgtaaaatggagatagcagcacccacttctttgagttgtgagaagtaaatgcatgtgaaatgtttagcgtgtgccgggcaccaagttaagagcccagtaaatgttggctgttaaaaaa

SEQ ID NO: 38947 - DNA, 627 bp, Homo sapiens
ttcggcacccaggtcggttcgccgccgggactgctgacggggagggctaggtagccctgggagtcgggatctagaaggtagaggagaagcggggctgtctgacccccggaggtgacaaggggagaggggctgtgtgaataccctccatgggcagtaatgggatgactatccccagggagcattgcgaaggagagaggcggctgagggactgcactttctggggccccccgggagagtcagagggcaacagagtgagactctatctcaaaaacaaaacaaaacaaacaacaaaaaatgggctggaggagcgggttgtaggcccttccgcctctggtgggtggggagaagcaggggagctggtgttcagctatattctacaaagaaggggtggatcctgagaggcaagggtgggactgaggcctagttacaggtggtcgggaaggaggttgaaggggaactgtgtgaccttggatgttctttgtaattatcttatgcttagctgacacatctgtaaaatggagatagcagcacccacttctttgagttgtgagaagtaaatgcatgtgaaatgtttagcgtgtgccgggcaccaagttaagagcccagtaaatgttggctgttaaaaaa

SEQ ID NO: 38948 - DNA, 972 bp, Homo sapiens
cagtcgcgtgtgcttaagagtgtgggcttcagtcgcgtgtgctctgcgcaagaaccgccggcgggtgtttgggctgcttgagcggccagtgctgctgccgcctgtgtccattgacactgccagctacaagatctttgtgtccgggaagagtggtgtgggcaagacggcgctggtggccaagctggctggcctggaggtgcctgtggtgcaccacgggaccaccggcttgcatggagaacacagatgccttcctcttcctcttctccttcactgaccgtgcctcctttgaagacctccctggacagctggcccgcatagcaggtgaggcccctggtgtcgtcaggatggtcatcggctccaaatttgaccagtacatgcacacggacgtgcccgagcgggacctcacagccttccggcaggcctgggagctgcccctgctacgggtgaagagtgtgccggggcggcggctggctgatgggcgcacactggacgggcgggctgggctggccgacgttgcccacatactcaatggccttgctgagcagctgtggcaccaggaccaggtggcggctggcctgcttcccaaccccccagagagtgctcctgaatgagtcacgagtggttgcctgtgatcccacccccaaccctcaggtctcgacatagggctggaggctggggcaggaacatggatcctatctggaggactggccagcatggcctgatcagggaggatgtggccagagaaggcccacccgcgagcagcgctttccttgcagaattcatggcagggaggtggggaccaaggccctgagctcgaacatctcccgtggcctttccccctttggcagcaccgatggaggatgactgggagagggggtgcctctcaagttacttcaatcaagaacctgtattggttgaggtgacaccatctgttgtaacagataaaccccgaaatcccagtgctgaactcca

SEQ ID NO: 38949 - DNA, 1484 bp, Homo sapiens
ttcggcacccaggtcggttcgccgccgggactgctgacggggagggctaggtagccctgggagtcgggatctagaaggtagaggagaagcggggctgtctgacccccggaggtgacaaggggagaggggctgtgtgaataccctccatgggcagtaatgggatgactatccccagggagcattgcgaaggagagaggcggctgagggactgcactttctggggccccccgggagagtcagagggcagttaagagggatcacaggcccggcttggtactgtcactccccttcccactccctgctctcagcattctgtcacctccctaccccgtcgcggtgcccagccatggccagacctcccgtgcccggttcggtggttgtcccaaactggcacgagagtgccgagggcaaggagtacctggcttgcattctgcgcaagaaccgccggcgggtgtttgggctgcttgagcggccagtgctgctgccgcctgtgtccattgacactgccagctacaagatctttgtgtccgggaagagtggtgtgggcaagacggcgctggtggccaagctggctggcctggaggtgcctgtggtgcaccacgggaccaccggcatccagaccaccgtggtattttggccagccaagctgcaggccagcagccgtgtcgtcatgtttcgttttgagttctgggactgtggagagtctgcactcaaaaagttcgatcatatgctgctggcttgcatggagaacacagatgccttcctcttcctcttctccttcactgaccgtgcctcctttgaagacctccctggacagctggcccgcatagcaggtgaggcccctggtgtcgtcaggatggtcatcggctccaaatttgaccagtacatgcacacggacgtgcccgagcgggacctcacagccttccggcaggcctgggagctgcccctgctacgggtgaagagtgtgccggggcggcggctggctgatgggcgcacactggacgggcgggctgggctggccgacgttgcccacatactcaatggccttgctgagcagctgtggcaccaggaccaggtggcggctggcctgcttcccaaccccccagagagtgctcctgaatgagtcacgagtggttgcctgtgatcccacccccaaccctcaggtctcgacatagggctggaggctggggcaggaacatggatcctatctggaggactggccagcatggcctgatcagggaggatgtggccagagaaggcccacccgcgagcagcgctttccttgcagaattcatggcagggaggtggggaccaaggccctgagctcgaacatctcccgtggcctttccccctttggcagcaccgatggaggatgactgggagagggggtgcctctcaagttacttcaatcaagaacctgtattggttgaggtgacaccatctgttgtaacagataaaccccgaaatcccagtgctgaactcca

SEQ ID NO: 38950 - DNA, 555 bp, Homo sapiens
ctagattttgaatgttttgcctgccagaaaccaatggttttaaaaaatcattgagtggtcctacagattcaaagcgagcatccaaacatccctcacatggcctcttacaatgacataaaactgaagcccacttttttatttggaaaactcaatccctttggacaagccacaataatttttcattaactacttgaggttgcctgcaaattcagctagctttccagcctgctatcagcaaagccataaacatcttttttaaaaataggttaaggttggccaggtgcggtggctcacgcctgtaatcccagcactttgggaggccgaggcgggcagatcacgaggtcaggagatcgagaccatcctagctaacacagtgaaaacccatctctactaaaaatacaaaaaattggccagccgtggtagtggacacctgtagtcccagctactcaggaggctgcggcaggagaatggcatgaacccgggaggcagagcttgcagtgagccaagatcgcaccactacactccagcctgggcaacacagcaagactccgtctc

SEQ ID NO: 38951 - DNA, 169 bp, Homo sapiens
gatcagaggcttcttaaatcaagtttgtatctaagttctggtccagtctgtgctacttagcatgggattttaagccaattgtttgttggctttgagcctcagttttctcatttgtaaaataggataagagtgggttgcaaattcaaagctcactgctgggcacacagta

SEQ ID NO: 38952 - DNA, 231 bp, Homo sapiens
ccaccgcgcctggccctgccttcagtgttgatattgaccaagaacagctcatccctgcctctccccaaaccaactctattaatctgctttaagtagtcacaaaataattcatgtgctatttaggaataaaataattccaaatgttgacacctcaccttttatcttgtaagatacactattgaatggccccagaacttaggatctgaagaataaatgattcttgtccagtca

SEQ ID NO: 38953 - DNA, 443 bp, Homo sapiens
tgaacacttttgtacatgctatgtatcctggagaaaatgctgtatttgtgaagttgaactctcctactctagaaatttaaaaatctgatattttcaagtattactctgaatttttgtttacattagccaggctgggaatttcttaatggttttggtctgtcagaaaaccaagcaatgtgttagaggctctaagtctatccagtatagttccaggatggtttcttgtattgttacttctttaattattacacaaatactgaatgtggatacataattgacagtgccttacatattcagataccatgagtttttcattttattatcatcaaatttcttattgagtagaaaacgcttttggacaacaaaagaaataatcctcttagtaaacaaacaacctatggcatgggacaaaccatctgcaaactatgcatctgacaaaggac

SEQ ID NO: 38954 - DNA, 286 bp, Homo sapiens
ttagaaactgaatcacttactcagtgaagcaattaaaaatgctgtcctaaattttgcatgttgaggcggggcgtggtggcttatacctgtaatcccagaactttggaaggccaaggcaggaagcttgattgagcccaggagtttgagactagcctgggcaacatagggagaccctgtctctacagataatttttaaaaagttagccaggtgcacctatggtaccagctacttgggaggctgtggcaggaggatcgcctgagcccaggaagtcaaagctgcaatgag

SEQ ID NO: 38955 - DNA, 2446 bp, Homo sapiens
  misc_feature (1216)..(1216): n is a, c, g, or t
ccaaccccctaaatcagaatccctggggttgggcccaagagtctccattttttgacaagctcctccaggagattcctccagacatggaaatcctcacttgactcttcccccataacaaactgccctgatgtctgcagagagagggtctgctgtagacagggattaagaaaaagcaggacattttcagataggatgcccaaacccagacgcagattaggacccatgaagtagggggtagagctgaccctcaggaatgtgcccagacagagctaagctttcaggaaaattagaaagaccctcagacccagagtctgtctgagtttagcttcgcagcatgaaggctgccttgagaaagctgatataacaagaagcagcagaaatttaatactttggaggggcccagcaacccactcagggccaccctgggagaccccacagaccccaaggctatggtccagacctgttcactcaacacctggccaggcggggcctccagctggacctagagctacagatgccccaccaccactaccaagcccggctacccagaccaagacacggcttttcctggaggagagagagagcaaaggccctgtctctacccaagacctaacggcccctgttgaaggagagggagcaggagagggaggagggaggaggtcacagccaggaccacatacactcttgggggccctgctgagactgcaagagtcatgaattctaacgttccacaggtgaaagattccaagattctaggattgcaaaaccccatcattctaagattccaatggaatgattccatgtttctaagattccatcacactatgattctatgctgctaattcttgaaatttcgagtctcattgttcgttgctgttccccagacctgtgggccctagcatttttttaaaagcacaaaaaaaaaagagcaagaaagagagaaagagatggggagggagacagctgaaaacagatactaagaaaagctccatcccttggatctgagttacagatgcaccttggcaagggccaaagaccctccttttgagtggggtgcagaacgtctttccctggtagagtggcagaattgcatgcatcaggccttcctgggggtaaaaggggctggctgttccaggctacagctgagtaaagccccacacaggccacagtgcccactggctggtggacctaggaaccaagcagggccccactggcncagtctggggagggactcatctggggtggaatttccctccctgcagcaaggaagctgcagggccaggaatttgccttgggagacccccactgaggaatatttccgaagcagaaccccttcctattcagagccagagtcttaacactggacaaccacagggtgttgctgcaaactccagagccaggtgccttccctctgacatttgggacatagcttccatggccacacagccttcgcccccttccaagaccccccttgacctttctaatcttagtcactgccttccagagctgggaggccacacggcagaggtgcctgtgaatcactccgtcatcagcctggccgctttcccctctgtggagagggactctgatgggcagggggcaccaagttgagcctctgaggctggcccagcataggccaggcagggacattcactcacaaccagcctttttggactctagagaagagtaattaccacttggtcatgcccagcccccaaatcataatcatagctgctatttcttgagtgccagcaatgtgccaggcaccgtgcccaactttttatacacaatgtcttgcctaatcctcacacctctgtgagacaggtacaattattactcccattccacagactagcaaactcagagacgtgacatggtggctctcccaggtcacacagccagtaagtggcctctgaccccagtaccccccacttaatcaccatgctatgctgctaccagtggtacacactcagcccctctccactgtcagatcctttgccagtcaaatcccagatccccgggggggcactgtggcaccctctttgagcgtggcctccctggagctgctgtcagagccatgggctgtgggagtgagtgtgcacactccttctcctgaagtgtctgccccagcctgagctatgcagaccggagctctcaaccagggtatggggctgtctggcagggtttcccagaaccctgtttcctgtggtcataaatatgggttttcctgacaatgttgggaggtcagggactgatacagctggggttccaaccgccgtgggtcagacctggctcctccggaccccactgctgtgaccaaggaaatctcaccagctgtgtccaagatcaaccctgaccctgttactccaatgcctttgtaggagtatttttagcagaaccgtttttttcccaaaataaatgtgaattgtaaaaattatcacttgga

SEQ ID NO: 38956 - DNA, 541 bp, Homo sapiens
cctcattagaagggctataaaagggatgcagataaagtaataagggaatttgtatcatttggacttcctcacgtgacccactccatggcttctggaactaggcagatctgagtttgaacattattacccatgacattggctggcacagtgtattttaagctatgtctccatttctgtcagtttttaaatgaggatagtgacacctaccttgcagggctgttgggatgagtaaatgagatactgtgtgtacagtgtaaagcagtgcttggcacaggtgagtccacccggaatggcagcttccttcctacctcctttatgccacgctgcatcccctgtcagtcatacagatgcctctcacaaacctgcctgcaccttacaagtgaaccacaagcattaagatggcttcttgaggctgggtgtggtggcttccgcctgtaatcctagcactttgggaggccaaggtgggtggatcactcgagcctaggagtccaagaatagcctgggcaatatggcaaaatctcagctcaaccaaaaaaaaaaa

SEQ ID NO: 38957 - DNA, 414 bp, Homo sapiens
actccttcatcctaccaccaccacacccttaaatcattcaatggctttccattagtcttatgataaagactaaaatctttggaggagccttggtggtactttatagtctgactctgcctctctcttcattcttatcttaacccacataccctctggctctcaggatggcaggaatgccaggcatctttctgtgacagaaatgtcccacattgtccatgctgtttcccctgcttagaatgcttcctgcccacctcctttccctagcgaagtcctgttcattagcatttgatcattcatttccttagggaaatctttcccaacctccatattatgtaccgtgctatgaattcttacagtactacattgccctctttttgaaagcatgtaactccatttgaaataatgaattcatta

SEQ ID NO: 38958 - DNA, 349 bp, Homo sapiens
catgatccttatcactgagctcccgtgaagatgttctgccacttaatttcctgatctttttcaggttactgatagtatagggacatggctattaagagtgccaaaaagaaatgcaaaggaagagagaaggaaatccagcgaattcctcaagccaaggtgcacactcaggccacaaggaaaacgcagggaaatcaggtattctaatttcttaacaaagagaaagccgtctggaaaccacggggccactgactgcttctgatttggaatgaatgggaaagctcgcaaagcatcaggaagcttgcagatgagccagcatgagttctcatctgaatttacgtcacaggcggga

SEQ ID NO: 38959 - DNA, 708 bp, Homo sapiens
gagtttaatagtacaatcaccacccaattggaactgggcactgacccatcaggataaaccccagccataaataaacaagcagtactaccttaccagcgtctacctgttgaatgttcatctaggtttcaccccaatttgtagtttactagggaacataactggttctgatgatcataccatgctgccaactttcaagagagagaaggggacactccccgtttataccaaagggaaatctttttaacaaccagataagtaggtcttctgtcttagttaaaatgttcagcaaaaccattttctcccaatggtaataaaaggcattcgaaatgatagattttgttttatggtttatgattttagtactgacctttgccatctggtctgctgggataaatttggaaattttatatctctaaagctactcagtttattttatctcactcttctagcatgcttttctttatttaggtgaaatgaaaagcagatctgtcacagtgtgtgcactgacagtagagttcccaaaagaaaatagagataccttgagacctttgttatccacaggaacgaggtcatggcattacccttttggacacatggtaggatagttactcaacacaagcattcctgtttccttaagaatttggagcatacctaattgttgttgctgggacatgttttttaagtaacgtgcaatttgctgagaaaaaa

SEQ ID NO: 38960 - DNA, 191 bp, Homo sapiens
cttcgagtcaatgaactttaagtaaggaaagtgaaaatcatacacatactcataatcttttttctattctaaaatgccattgattgcaagattatttagctttgattatgacaacttttctgcaaaacaagatgcaataccacattgaatgtgtacactgattgtctgacctatccaaatatcagaaaaat

SEQ ID NO: 38961 - DNA, 296 bp, Homo sapiens
agaaattaaacaacacaatttaaaaatgggcaaaggacttgaatagatatctctccaaagaagatgtacaaatagctaataagtacataaagctgctccatattactaatcactacagaaatcaaaaccacaatgagataaccacttcgcctccatcaggatgggttttttctttttttgagttggagtctcgctctgtcgcccaggctggagtgcagtggtgcaatctcgactctctgcaacctccgcctcctgggttaaagcaattctcctgtgtcagcctcccgaatagctgg

SEQ ID NO: 38962 - DNA, 222 bp, Homo sapiens
acttctctttcttgagtcgacgaaagtttagaaaaatggaaatttccaggagggtgctttataatggctttgtttcccattactctttcttgcatgttatttatttttaatgagagaaaaattatatgtaggaaataaaagagaaacgtggctctggctgtgtaagcataggaagccttgagcttaacacaaggcaaattgcaaagaaaaaaaaagtctaaa

SEQ ID NO: 38963 - DNA, 974 bp, Homo sapiens
ggaagacttacggctaaggtagcgaggccgggtgtttttcctagtttcccagtcatcatcatttatggttatattagtcatgcacagtaatttgcatgtaattgagtatttattgaatgtatgaaaagatatctaatataatattgttttaggtgattgaagtaaaagtacattttccccactgcctgatttcctttcattctgggtttttttttgagagacagtctcaccccgtacctaggctagagtgcagtggcactgccgtctcgggtcactgcaacctccgcctccccggttcaagcgcagtggcgcaagtctcgggtcactgcaacctccacctccccggttcaagcaattcttgtgcctcatcctcccaagtagctgggattataggcgggtgccgccatacctgactaatttttatatttttagtaggggtttttgccatgttggccaggctggcctcgagctcctggccttaagtgatcattctgtgttgactgtttacctatgtttccttatgttattgtaacatcatgttttttccttagagctctttgaaactgttttcaatttgttaattattatgtgcccactatgtgtcaggcacattccaagaacagtaaatgtaattttttagaaggtttatttttcaccaattgatcttctcacttttgcccagtggttggatataactactaatttgatcagaatataatgagtcatagtaaccaagctcctcccactccacttctttcctaatccccagtactctccatgtccccccgtcaaatgacagtgtcatattcaaggattgtcactttgactgtaactgatacagacctaccttggaggatagcatttttgtttaggaatatttcatgatgtacctagcattttgtaagcagaaaggagtgtcacttggctgtcctgctaattctgcctatttgggggaggtggtgaggtctaagcat

SEQ ID NO: 38964 - DNA, 484 bp, Homo sapiens
caggagaggaaaatgaaattgaggagtaaattaattggctgagcattaaggaagcccattgtcacgattgctgaggttctcccttgaattagcagtagactgcaggtttcatctgagtatgagccaccaaggcaaatcagaaacaaccgaacaaccaaaaacttaaaagtagcaattcccagtgcagaatccactccagagcagtccccgtctcaacacctggaagtcctaggcttggggctctctcatctcgcctgcttcccgatttgtttggaggtgacagtgtttttacctactgagcaaatgggaggatttgggttgtttaagattctctgggggctggacaagggcccttgtaagtctgtgtttgaagaagtggatgggctcaccaacaaaactccttcctgtgctgcctcttggcgtatctggccttggtcataggttctaagttgtttttcttttcctgtctaatgtaagtgggtga

SEQ ID NO: 38965 - DNA, 414 bp, Homo sapiens
gcctccacaccagccccctccctcttcaccatttccccttcaatagcaccactctcatcatctatgggggacagtgctttcttctctccctgcctcctccatcaaaatcttttctcaggggagggtctgaaaaggccttcactcccccgtaaataacgaatggtgcttacagggctgggctcccacgtgcatgcacattaacaccaaaggtgctgtagtgaatggaatttggggcactgaggggaaggagtggaggtgttggtaggaacttgttgctggtgggggatgggcgccgtagatatcctttacaccactggctactccccctatctcctctggggtgaccctgagtatcctctgtgggacaccggcatcctgtgaggcgccctccttgcccacattgacgctgcgctg

SEQ ID NO: 38966 - DNA, 390 bp, Homo sapiens
ctgctccaactagtacttgcagtttcttaaaaccatatgttcattttactaaaggagttatccctccacattgtcagctgaaccaatggaatccagtacagatgaccatcgctgctccccagagttcttcccctccattaagccatttctatggtataggggcagaagtctcagggaacaacccccataggatcctttgaaatgcgcttcattgccgcctcacctcctccacccccttctccctctcttaagttctccgctaaccaaaccttctcttgttatatacccaatgataaaaccaaagtagttgtagaggttaaagatttaaaacaaactatagcaattgacacagggtatcaggacacaaatgcttggcttgaatggattaaa

SEQ ID NO: 38967 - DNA, 564 bp, Homo sapiens
gggcacagacactccatgctttacagccattactggggagtggggaaggggtggttttggctattcaaaactttccctcctgccctcctcaatgcctcttgcaatgatacgaagtttaaaccagatactgtgattgtctacctgatttttggttcttgtgatggtgctctcctgtgttcagatagttgttaaaatttggggtccctgcagggggattgaacagtgtaggcttctattttgccatcttcctccactctaagatgaaaccattgcgagtgtgtggcacctcccctctctctctctcttgctccttttgtggctatgtaacgtgcctgctacccctttatcttccatcatgattgcaagtttcctgagacctccccagaagccaagcagataccaacatcatgttcctgggcagtctgcagaaccttgagccaattaaatttcttatctatataaattacccagtgtcgagtatttctttatagcaaagcaagactggctaatacacagttctaagatgcaagtttatagtgtttaatgcctacagtgaaaaaggta

SEQ ID NO: 38968 - DNA, 366 bp, Homo sapiens
ctgaaatacataacatattaatgaggatatggccaacctcactgataacaaagaagaagaaattaaaatgataggtgaaaaatacatttggctgtcagaaaatttaaagattggtaatacacatttagtatagtttgggtatggtaaaatgactattctcatgagttcgttgtgagtataaattaggtaaaacctgtttggatgaaagtctgtgaatatgtatcaaaagcctttaagaaagtatataacatgtgacaagcaattttgcttttaggaacttatctgaggaaataagtgtacaaatgtgaagtcgtgtgtacagggaaatttgtactggctttattacataactgtgcataaactgag

SEQ ID NO: 38969 - DNA, 2076 bp, Homo sapiens
  misc_feature (330)..(330): n is a, c, g, or t
tttgaaaacagtttttgaatagaacctgttgagtccaccaatataataaaatcagctgtttgtttttgaaataaatacatatttatttcaatataataaaatcagctgtttgtttttgaaataaatacatatttcaaaaagtataaaattttagttgtttcagcgcttctttttactcttgtgtcccagtttgcatgataaattatatagtattcacactttaaagacatttctcataagttatatgagatttttctgcttacatcctgttgaccagaatttaattatatagccatacctagctgtaagggaagctagaaaatgtaattnttattgtaggtcatcatggatccagccaaaaatctggaagatacagataaaagatactaggagacaagtaacattctgccctaccttctcatcatgtgtttgcatttttggctagcacatatactcatgaggtagacctgcggaatttaagggagaaagtagtatggtacctttaatatctaatttatattcatatttttttaaaagctaaagtaaaaaatgaattgatcctattaagcagactattagagaatcttggtcaggcatggtggctcatgcctatcatcccagtactttgggagatggaggtgggaggatagcttgagcccaggagttggagaccagcctgggcaacatagcaagaccctgtctctacagaaaaaaaaaacaaaaaacaaaaaacaggcatggtggtgcatgctgttagtcctagctactcagcaggctgaggtggtaggatttcttgagcttaggagttggagactgcattgagctatgaatgcaccactgtttctctagcctgggcaatagagcccctgtctcaaaaaaaaaaaaaaaagaaagagaatctgatgtctctctccaattctattttatttcatctcaaatgtctctctcctttatgcatatagtatactttgacgggtcccactaaattctctccttcactggaattcacatgttaacagaaggtgagtggttctttgcccctgggactcacaaactgtatcatccatctctccttttcaccatatttgcagtggtctgtgataaaacttagcccttgtttagagaagaaagaggcctcagaaagtgcagatctgacatagtgtctggacaccttgagctgcacatgaccagctctagcttcacaggctggccgttcatggattagacctacaaagctgaggggaggagatattctggaccttgatagtacctaggtccacattttggtaatttgcctcggtatagttgccaccttagaaaaccaagactcgttgcctttggacaaatttctatttgttttctgtaatcatttgttttaactttgaactattctgatgaaatcttacataaggttcaaacggtggtattgtatacaaacataatcatgttaaatgatacaaacaaataatcacttgtttaaactgcttccctttatgggactaatatttaacatgttcctttttcttaactagcttgtgtcagtcacacatgctttttttcaatgtggttcaagtacagtgaaaatggaagctttactcccatcaaaatcaaatcagattcacagcctgtgaaatccactcttggtgttttgcattcagaagcatcactataaatgttccagagtctaagacctccaccatctgctccattaggcactggatttcagtagcactacttgatttagaaaaagaaaaagaaaaacttagcatatccaagcaactattcagcctgaagcttcttgaaataagaatgatctggcatttccttccccttcagtgagcctcataactccatggtctctgcacaggtttacacctttaaatttgcattttatcaacctttctctggtgaggaattttttcctttttaggctatgatatgtttttttctgaatttgatagttgtatgttgaattgaaggctttattctgtgcagccctcctgttaatctcaaacgtgaatcttttgcaccttgttcttcaaagggtcattgaaggctctaccaggtcaatttcag

SEQ ID NO: 38970 - DNA, 449 bp, Homo sapiens
aagcagatcactctggaaattcttgccatgctttgggcattgacagaaggttccaggggcactgttagtcctgctacaccccttggcagacggttcttccccaagagacaaagtcgcacctagaaatttgagagcacgctgccctgattggtccctcactgtcacattggatttggacttgagacccagccaggctggagggagaggagccagatgggacattctcaagctgcgaaggggttttgtccagtcctgattcagggcgctagagtcccaacatggcacctgagaaaaagtgaattgggtgtcctcagttcagacccctgggcacagcttatggttgtttgatttaaaataatctctcagttgctctgtggcctatgtgtaattgtattactatttctgtggaaaaggaatcacttctttttatacatagtttgaaaaaaaaa

SEQ ID NO: 38971 - DNA, 385 bp, Homo sapiens
gacaaaacagccagccagtcttctatgagaaagatgtcacttgccacatacagtcccagttggtttcactgtcccgagaccctaaggatgttttcgtagagctttgaccttgatgaagcacagagaagtgtctggtccccatgcccgccctcctcccctttaactcctcgcctgccccttcaacttcagttttctaaagagaaaacttgctccctaagctcccagaaggcattactcaggtgacatttggggaaggaaatgatcagtagggcaagttttaatttagggcatttaaacccattgtgcttaagtaccagatttcattgcagactctttagaaaaaatgtatggcatcttgacgcagtgttcctggccaaaaaagaaa

SEQ ID NO: 38972 - DNA, 438 bp, Homo sapiens
gggattacaggcgtgagccaccgcgcccggccagaatgtagaatatttgaaaagcaactagtctggtctgtgcaaaatgttaaatataatagggagagaaaaaggtaggggtacaattctagattgaaagaaacaagtacaacaacccaaacgcaaccgtataaacgcctaacttgatcttggtcgaaaaaccaaacagctataaaggaagactttgggaacagctggggaggaataaaaatggactggtattagttattctaggaaatctgttaattttcctggttgtgataaaagggtatccataggtatgtcaaagaatgtcctcatgaggtgcatgtctgcagtttactttcaaatggtttgacaaaaatgtatacatttatgtaaagcaaatatggcaaaatgttaagtttttgaatctaagctggagaacat

SEQ ID NO: 38973 - DNA, 381 bp, Homo sapiens
agattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaa

SEQ ID NO: 38974 - DNA, 405 bp, Homo sapiens
tgctagagccatcatgttggcattccagccttcattttgagtagacagtacaaagatgtgtacaagaagggcacatcttctttcttttaaaattatttgcataactcttccatttacatctttttagccagaactaggtgtcttagtcaccccttgctagagggagactgggaaataggttcttttagcagagcagagtcagccctctgtatccacaggctgtgtccttgcagattcaaccaaccacagattgaaaatattcagaaaaaaataacaatacaacagtaaaaaaatacagtgtaaagactacctaggcgtttacattgtattagctattgtaagtaatctaggagattatttaaagtatattgggagaatgtgcataggtttaaatgccaatttgac

SEQ ID NO: 38975 - DNA, 433 bp, Homo sapiens
gctgggattaaaggcgtgagccaccttgctcaacctaaatattgttacataagtgtatgttaactgtaccttatatatactcccaggagcaattgtggttatagaaaaaaatgtgggcaaatattttgaagttcctgaatttcatgatagtacactatttaattccatgaagaaataacctaaaaagaaagtgtcacaggattatgacttcttaaaatacaactgtccaacagtctgctgaaggaaagtgcaagtaattagtcttagattttgaattgtgtagaacttttgaaagttaaagcttacccccacactggggagatgtttcataagaatacagagtggctgtgtgcagtagctgatgcctgtaatcccagcaactttgggaggctgaggcgagaggattgcttgagcccaggagtttgagcccagc

SEQ ID NO: 38976 - DNA, 422 bp, Homo sapiens
ctaccccattttacaaattagactcgaaggggttaagtgatcacactgacgcaaggcctggaacctgggtcagtcttgcttcaaatctagggctctttccacgctgcctgccaagccgcctcctctagggaggtgatgaggaaaagctgcaatgttggaggagggggagctgcaccgctgaccctccggtggagaagatggggtgggaggcaacagcagaaatctgctccaggggcgggaatgcgcagccagggctgagagcagccaaggcacagaggatagcaggctgggcaggcgacagcgccggtgacagctgtgttagggtgggcagttcggtacgccgctgcgggagcgggcggggaacgtcagcctggaatcctgggtcccccgacccccggagtagtgtcaactcagagcaccac

SEQ ID NO: 38977 - DNA, 446 bp, Homo sapiens
gtattcaaatattgataaggaaaaagtaattcttcatgaaataattctagctaacaagtagaattataataccatcatttgcaaccctaatgaaacaataggtccgagtgttatcaatggctgctaaaagcattgcatgaaaagccagtgggaaattttgtaatggatgaatctagctggccccattgatatatcttaatgttacaaaaagggagatgactctgaaaaaaagaaaaaagaaaaaaaaaaaacaaagatgaagctgaattggattactctctcaatataacacccatttataagaaatacaggacatagaagaatatgttaaataataccacaaggatacaatcaaccatatccagactctaatgaaacaataggtctgagtgttatcaatggctgctaacagcattacatgaaaagccagtggggaattttgtaat

SEQ ID NO: 38978 - DNA, 358 bp, Homo sapiens
tttttttgagacagggtctttctctgtcacccaggctggagggcagtggtgccaccttgactcactgcagccttgacctccctggctcaggtaatcctctcacctcagcacccatggagcagacaacagttgggactacaggcacgtgtcaccatgcctggcaatttatttttattttttgaagagatggagttttgccatgttgcccagactggtcttgaactcctgggctcaagcaatcctcctgcctcagcctcctcaaatgctgggattacaggcatgagccactatgcctgaccatacaacattattttttggctcttttccttcctatttcccaatcttcttttagggtcat

SEQ ID NO: 38979 - DNA, 366 bp, Homo sapiens
atttttttttccttgtgtctgtccctaccccctgctatggtctgaatgtgtgccccaaaattcaggtgttgaaactgaatctccattgtggtggtattaagacgtggggccttttgagaaatgattaaattaagggggctccgccttcatgaatagattagcgccttataaaagggctggaaggaacccagcttgggtcccttttacccttctgtcccttgcaccacgtgaggacatctagatgaatgagtctgtaccagacacctaacctgccagcgccttgattttggacttcccagcctccaaccgtgaggaaatgagtttcttttatttcaaaattaccagtctgtggtattttgttataac

SEQ ID NO: 38980 - DNA, 594 bp, Homo sapiens
cattcagagtccaatggcttttagttttaattcacacacttaacgagtttagttatgccagaaggttggaagacaggtgagggtggctagaggcagacacgtagacataagacatcctgacagcaagggagatgacaagaatcagtaatacagcatagctgagccattcaccacagggacagttgtgctctacaagccacagtcaggggctaacaaacatactaaaaaggaaaatactaaagcactgtaaggttaaattatactcactatatcctactaaataaggttggggagactgaaatttattttagaaaatgttacctaaaaaattaatctgaaagagtagaaagaacagtgtacagccttagtattgttaaaaaaaaaaaaaaaaagatacctatcccataaggtttttacaaagataaaatgtggcaatgtacatccggctccaagatggcacttcacacataacatagaaggtttttagtatgtggtagtagttttcattacaaataacacttaaaaataggtttcccttatctggaaaattcacttttgtggaatatctaacttcctgatcaaactaaataatta

SEQ ID NO: 38981 - DNA, 334 bp, Homo sapiens
ctaggcctagccatgtgtaatttattattaaaatcatgttaccaaaattgtagaaaataaaaaagggtgggtgcagtgtaatcccagcacttcaggaggccaaggagggagtactgcatgaggccaggattttgagaccagcttggacaacatagggagacaccatctctacaaataataaatatttagccgactatggtgacgtgcgtgtgtggtcccagctactcgggagactgacgtgagaggatcgcctgagcccgggaggcggagattgcagtgagctgtgattgtgccactgtactccagcctgggtgacaaagtgagacgctgtctc

SEQ ID NO: 38982 - DNA, 652 bp, Homo sapiens
tccaggagtttgagatcagcctgggcaacatggcaaaaccctgtctctacaaaaaactacaaaaattaggcccggcatggtggctcaagcctgtaatcctagtactttgggaggccaaggtgggtggattatgtgaggtcaggagtttaagaccagcctggtcaacatggtgaatccctgtctctactaaaaatataaatattagccaggtgtggtgatgtgcacctgtagtcccagctactcaggaggctgaggcaggagaattacttgaacccaaggaggcagtggttgcagtgagcctaagattgcaccactgcactccaacctgggtgacagagcaagactttgtctcaaaaaaaccaaaactacaaaaattagcagggagtggtggcatgtacctgtactcccagctactcgggaggctgaagtgggatgatcacttgagcccagaaagtcaaggctgcagttgagtcatgatcctgtcactgcattttaacctgggtgagagtgagactgtgtctcaaaaaaaaaaaaaaaaaaaaaaaaaagaaagataaatagatcaatggaacagaattctgtacagaaatagactcacacttctatagctcatttcaacaaatggtgttggaataactggatatctacatgg

SEQ ID NO: 38983 - DNA, 313 bp, Homo sapiens
taaggtcatcctctatggaccagagaactctgggaatttcttgcctcttgggatccagaaccagagaaacagcagagcatagggtgacttacttgtgggctcccacaaacagaaggccactcagacctgctgtttgccacccctgcccattccttctttggtcagggtttttggggtttgccagagatgtgtttaagtgctctgcccagaaccggggggaggggggggtttggtggaaattttttgttatgatgtctgtgtggaaagcggctgtgcagacattcaattgttattattatgtcctacaagtata

SEQ ID NO: 38984 - DNA, 335 bp, Homo sapiens
aagagagtagaaatccaaaagatggttacctttggagaaacatgtgcttattccattaatgttgctattgctctaagcatgctgggaagtactggagagctgttaactcttcaggtattagaaggagaatctcatgtttctccaaatttccttgcttctgggatacaatttctggttcttttgttaccctaattgccttcatctcgtatggattcgtatctctccttttatgcccagctttcagagttcattgtctcactgcaggtatgatatgagcagcacagagcctatggttcattaacaatgcaggaaatgacatggaatcacaccgtaac

SEQ ID NO: 38985 - DNA, 418 bp, Homo sapiens
tggagggagcagtgtgagtaaaggccctgagggcattcatgttcagggagggttgctgcccactggcttgcttggcacacaggagagtgggtattcctgccttagtaactttatgtaaacaagtatttcctcagtctgttcctctcaaactgcctgctctggcacattcagaatgtcacagaactcacctggatgcattcagccccttgcctaaaggtgacagtgcatctccttccccaccccacccctcataccactgaagcacctgtcagactggcccagtctgtgggcaaggagcctagagagggcttagtttcagcttgaaaggagctgggatttaccaagaagcaaatgagagacgaggattgcaacaactgtgccatttccccagcttcagctgactcctgtatattgactg

SEQ ID NO: 38986 - DNA, 237 bp, Homo sapiens
gacctatggtgtactttctcttcattttttcccctatttctttttctaaaattaattttactctgtatatttgaggtttacaacatgatgctatgggattcacagagataatagtgactatagtgaagcaaattcatctatcaatgatctcgcacaaagtaggccctttgtatctgcatgttccgcatttgcagatcccaccaaccacagatcgaaaatacttgggagaaaaacaaa

SEQ ID NO: 38987 - DNA, 562 bp, Homo sapiens
tattcgctctctgctgaagaagatttcttgctatttcaggtggggctgatgggcacatcgtgaggggccctcttccgtaaaaacgagacgatgtcaggcaaacactccttaccctgccatttctagttacgtcaaggatcttactgctccaggacggaggaccttcaaggaactgcagggtagcgataatcaccgatgcagttaagccgggccctgggctgattcactctcagaccccggggggagtggcccttgcgcccgaaagagggctacggcgtagacccggcccggcacccaagttgactccttgcttcccgtaccccaaaagcctaagcgcggaagaggccggggacaccaaagaaacccgcaccaactccccgacccaggccctggggaaaaatggcgaagcccaggggcgggggacaggacggagcgagtgacctggcgctccccgggcctcagagcccgtggagtgggtcgtggtgggcgacgccacgcaaccgcgacccgtccgttgcctccgccatcttctcctactcacccggactccccccgcggccgc

SEQ ID NO: 38988 - DNA, 443 bp, Homo sapiens
ccccataggggttaacaccagctgatcatttactagaaagtggcctcccacagagaggggtgtctggtactctctcccagccctgcagccccttagaaccatcatttccttgtgaaccagcattacccaaattacccgacaccctcagtcaggccatctctgaccattgtacatcttttgttatgtagactagggttcatttagggttacttcttgtagaattctttttctgacccatctttaattgtataagaatatttacaatatactatttgggagaaagggaacttatgaagattattttccatatatttaaaaaataatagaaataacccaattgtgtaataaggttatagaagatttggtcctaagaacttcttttttatttccattgtgaaatagtcaagggaattgagcaagaaaaagattaaaacatgtaaaag

SEQ ID NO: 38989 - DNA, 772 bp, Homo sapiens
agcgggagtttctcttttcccctcccttcttcttcaccttcttccttctatttatccttctgtttcatctacaaatatttgagtgtcactgtgttctaggcactgtgccagacattgggattcgttggtaagcaagagagagaggcatggcctctgtccttatgagcttgcagtttatcctagtgttacttatctagtctgccctgccttcaaggttcagtggaagcccgatcttcatgtagtcctttgacttctttggcccttgcaaacctatccctttgacctatgctactttaaatctgattcatacaatttagcatttattgatataatttcttatactgtgggctaattgtttaaatatcttgttttactggctagagtatagttccttaaggacagagactgtcatgttattatttttttttttggcaatactgagcccaaaggttttgatttcagtctgccctgctgaatgttgaagttactagtagctcttgggacttagaagtagtgatgagataatgccttgctttttagtttattttctatttggttattttatgtttcttttttgaaatggtatgggctggccgcagtggctcacgcttgtaatctcagcactttgggaggccgacgtgggtggatcacctggccaacatggtgaaaccccgtctctactaaaaagacaaaaagttagccaggtgtggtgccggggacctgtaatcccagctactagggaggctgagacaggagaattgctcgaacccgg

SEQ ID NO: 38990 - DNA, 359 bp, Homo sapiens
ctttgtcttactttcactcaaactctaaaatctttttcagaagtctttcctactggccaggcgcattggctcatgcctataatccagcactttgggaggccgaggcaggtgtatcacctgaggtcaggagttcaagaccagcctggccaacatggtgaaacccccgtctataccaaaaatacaaaaattagccaggcatggtggcaggtgcctgtaatcccagctacttgggaggctgaggcaggagaatcgcttgaacccaggaagcggaggttgcagtgagctaagatcacaccatggtactccagcctgggcgacagagcgagactccatctcaaaaaaaaagaagtctttcctac

SEQ ID NO: 38991 - DNA, 255 bp, Homo sapiens
ttaagagacagatctctcctgttgctcaggctgttcttcaaatcctggcctcaagcaatcctcctgccttggcctcccaatgcactgggaatacaggcatgagctaccatggttggcctctgttcatttttcatagttcttgtcattatatatacatacacacatacatatatcatacataattcattcattcaatgaacattcactgagcacttatggctcacaatcaagtagaggagagacacacataaacaa

SEQ ID NO: 38992 - DNA, 715 bp, Homo sapiens
ggatttctgaaatcatctgacatgggccttttcttcagtccattccagattgggggagaatagtagggacccatattccaacatcgccagttcctgaagtcaagtctgagatagggctgtccactgggcactggccgggtttcacctcctccattcctacctcatgtctttgctgttgataaagaaccttagacgccctccatttgccctccatttgagaatgaagtgagggaacaggatacggttcatctgcccattgtgttgtattccacttttccgccggggcattatgggctgcactttattttacttcatttagtttgtttttttcctctactagaatgtaaatccatgaggaagagatatttttgtcaattttattcactgtttcattcctagcacttataatggtgtacagtgcctagtaggcacttagtaaatgttggacaaatggccgtttcccagataacttattatttcataatgattattacgcatccttggttcatgcctctcaatccatctcatcctaaatatggctactaatggcagttacatatgttgaaattcaccttttgaaattctagtttggccaggagtggtggctcatgcctgtaatcccagcagtttgggaggccaaggtgggcagattgcttgagctcaggagttcaagaccagtgtgggcaacatggccaaaccctgtctctactaaaaa

SEQ ID NO: 38993 - DNA, 838 bp, Homo sapiens
ctagatgtggtttttgaattaaataacataatggtgctcaaccttttaaacctcatttgctatcagtgatacttcaaaaaaccttattcctactattgataaaaacaatatgtctgcttttctaaggccatttatatattcaacgatactcctattataatttggttaactatttgatggcaagcatggcatagtttagaaagcaagagctttagagtgatgtatctgggcaccattcctgagtaacttgtgttaatgttttaaatttactaaacctgtttttctcatctgtaacaccagaaattgaccttccagagttggtaggaatcaaatgaaaaagcacctctaaggtttcttgcacatagtaatgatgcaatcagtgatagctataataaaaagatagtattttaaaaagcagctttatacataattcacatattcaatttacctatttaaagtctaacacagttcaatttatatatagagttgtgcaactttatcttccattgcttataatacatttataatttattggaaaatttataaggaaaatgaatttcttacagttatggaagctgagaaatcctaggttgaggggccacatctggtgagagccttcttgctggtggggactctgaagagtcctgaggcggcacagtgtatcacatggcgattgctaatgtacttaggtctcttttcctcttataaagccaccagtccactcccatgatagcctattaattcattaatccatgaatagattaatcaatttctgatgacatagcccttatgatccagtcacctcttaaaggccccacctctcaatactgccacattg

SEQ ID NO: 38994 - DNA, 354 bp, Homo sapiens
cctttatccttatattaaaactgtatttttgttctatgtacaattctaggttaaaagtttgatttcatctttagcttaaaattatctctccattgtcttttggcttccagtgtttatattagaaagtcatatgttcatctgatcttgttcatttttaagtagtttgttgttttttggtacactttgaggtgtttcaatctgactttttttccccctttaattctgagaaattcttaaatagtcttatctttattttctcctggaacttctatagtatggatagtgatatttctacttctatttctatctattaaattttgttgttttctgtctcttaattcccacaaaaaaatt

SEQ ID NO: 38995 - DNA, 393 bp, Homo sapiens
gtgatctgcctgccttagccttccaaagtgctgggattacaggcatgagccaccacgcctggcccagagtttagaaatcttaaaacagttgagacataaaataggtattctaaatgtctacaaaaacatatttcagtggctttatagggaacataggagactttgctgtcattgcaccttcaagttttggtctgattaaaaaaggtgcctaagttccttggaggcttagtgtttcttcatgtttatatttcagagttcttaatagtgatacttaaatatactattttttccctgtactttcgaagatttggatatgagttttcagatttaaatgtgggaactcatttgagtataatccgtgaacagcatttgttcaacacatttttggggagg

SEQ ID NO: 38996 - DNA, 269 bp, Homo sapiens
agtaacctctagattttgcgcattttcctctccttctagaaaagagataacataattctacccaaatctacactcatccctaacatgtaggtcaaatgatcttttatatataagcctcccaatattactaatgatgaaatcagactaagtgatttttcagaaaactccataatcgctactgaatatgaagtttctttttagagaaatgaaaatgttctggaattagtgaagaggctgcaataccttgtgaatatactaaaaaaaaaaaa

SEQ ID NO: 38997 - DNA, 387 bp, Homo sapiens
cagcttgaaggttcaagttcacttcaaaccacacacgaatttccttttatttttactttgcactgccaaaactgggggccttctaactcagaagacagggtgggaaagtggccttggtccactgagcagtcctgaaacaccaccacccaggcaggatgccggccgaggaatcccattcagtccccatgggaaggagggggcccccagccaccgaaaaccttgggcagccccagcctgctccttcttcctggagttttccagcttccccacaacttgccttggggttgttcctattggagtgtgtgtcagcgtgtgtgcgtggatatgtgtgtgagcaggcatatgcatgtgagcctgtaggagtatgcatgagtgtgcgtgcatatg

SEQ ID NO: 38998 - DNA, 461 bp, Homo sapiens
aggatatttgctcttaaaacaaaatgacagactgaattttcctcttatacatttaactgagcagaaaaattcagtatacattacctgaagatgcaaagttatgggactttaaaactctggttctctaaactcaaaatttctacatcaatccagcagggcaacagggaccatggcccagtgaacacaccacaccccggcactccaatggaacccaaattatattttaaaatgaaaatcaatgggaaaattaagcctcataatataaaatttggctttataatcagcttttctgaaacatatctattccaaatgtgcacaaatatctgcataacaagaatctattagattaaaatggtaattagctgttttccattccataggaaaggatttacataattaacaacagacacaaacttatattaagcaaaatctaactacagtgaaatctcaaccagcttagc

SEQ ID NO: 38999 - DNA, 440 bp, Homo sapiens
aagatttggctgccataagttacttgggaatcttgttttagactcttagatagttgaataagcctgatttccacctctgttaattattgtgacttcttatcgacatgaggacccaatgttgttgtattactgtgatctttgtaaggtggaaaaggtttaaaataacttggaatcataaagttgttttccccaaaacatattgtgaaaatgttcaaacatataggaaaaattggaagaattttacagcaagcacctataagccttatcatctagattctactattaacattttcattacatgctctaacacatatctatccatgtaactattctgctgtctacccatcttatttttttgatgcgtttctaaataaattgcagatatcagtacattttccagaatcatagaggttttaggcttaagagtaattttcaagctt

SEQ ID NO: 39000 - DNA, 367 bp, Homo sapiens
acaacaaaaccccacaagatccgtttaattcctaacacatacatagtcctttggaagatatctgtgtgttatatgtttattattaatagggagtaatgagacttctttccatgccctctacatgcacaccctgagttcctgacagatacgtacttttaaaatattagtgagcctttattgcacactcactatgtgacagcagggctaggaattgtaagcctcattctataggcaaagtaatgcaggcaggaagatgccagcactacacatcttgtcagtggcttcaaaatatgtggcgcttcctggtgtcccgtggagattctgtacacaaagactcaacaatttacttaaatgtcagaggaaaatc

SEQ ID NO: 39001 - DNA, 267 bp, Homo sapiens
ataatttgagctccttgcagttggaattatatcatctttatttctttctgagcatctagaacagtggtctatcaaagaataggtgtttaataactacttgttcaatgaatcagtgaatttgtttccttatttaaatatttgttgccagccaatacaacatggaaggctctgtgcagggggctggtgtggatgcaaaggtgtatagggcacattcccactcggggttgggacagtttaaggcctgccggggagacagacacgcagctg

SEQ ID NO: 39002 - DNA, 1174 bp, Homo sapiens
tagttttgtttcatgtatacaacagctgttacagatatatgccagcaatattcatacttttttaacaagcttttgttatatattttctaatctccataaaagtctaatcatctatgaaaaagatatttagggagaaaatacttgttttctgtaataaaacaattaggttggtgccatgtatgccaagttggataaaagaatacaaagaaacagctgaaggttttgggagctcgctctgacattaattactagaaagcaaactaaaatgcaaagtgaatagttaactcagaagatttgaattttttgaaatagggtctcactctgtcctctaggctagagtgcagtggcactatcacggctcactgcagcctcaacctccctgggctcaggtgatcttcccacctcagcctctggagtagctggaactccaggcatgcaccaccacacctggctaatttttgtatttttagtagagacgaggttttgccatgttgcccaggctggtctcgaactcctgggcttaagagatccacccacctggcctcccagaagtgctaggattacagacataactaccacacctggcctgaagatttttaaatgtgaaaatattttaagaagctaaggggaaaatcgttattttaaaatcctgatccccttaactttaccccttaccattccccttacctttccaattcacttttgtctatttattatagaatcagaattgtgctaagaagaaaccctggagataatctagctagtctcccactccctcaccccaaccttcatcctcaagaaacagaggctcagaggttgtggtgtgatcaagatcatatacctaaagcagagccagaatcaaacccagtctcccatgggtttggggaggcagtgggttgttaactccattttgcagtttctttatagttctggtctagtagttggtgaatacaacacattaagaaaagtgttaaatccagaaaaaatgtagagtaatctagatggggaaatgttggaaatgttaagtatatctacagatgtaaggatcaatacattattctaatttatgccttactattttctgccacataacagttgtatgctgccattttatagttgaatacatttgttgggatttatttaaatataaaataaaccctgtgaaatggctttg

SEQ ID NO: 39003 - DNA, 176 bp, Homo sapiens
aggactctacttgatgctgcatgattgcaaggtcttctaattctgaatatttgaaacatatattatcctcagcttctgtgtgagctctgagaatggttcagtctaatgctttacaataattctttctctggcctgaagtagtttttttcttatgcatgcacaaagcagtaataagg

SEQ ID NO: 39004 - DNA, 364 bp, Homo sapiens
gatacacaggtgtaataatcttaatttaaaaaaaattttttaatctcagattttttcctgtgcaaactaaacttaataataatggcataggaattgtttcaataaaccataaaatctgttaggccagttaggccagttaccaaaaggcaaaagaaaagaccttctacagtgtaccaaatattatattggaagaaaacatttcctttagacctttaagaaaacattgttagcatcaggccacaacaaacagaacccaaggaaaaacaacttatatgagctgaaaatgagttgttagtatttcgtggcctttaaaaggggagaaaaaagcaaaaatagtgagatgcaataaaagttgaactttggt

SEQ ID NO: 39005 - DNA, 238 bp, Homo sapiens
tagagtttctgtttgaagtgatgaaaaattagaaatagttggtgatgatggttgcacaacattgtaaatgtaattaataccactgagttgtacacttaaagtggttaaaatggcaaattttgtgatgtatattttactccagttttttaaaaataatagtgaactatacaaaaacatttgaattgtactttaaatgaatgagttatgtggtatttcaataaagctgttaaaaaataca

SEQ ID NO: 39006 - DNA, 339 bp, Homo sapiens
tgatgttcctgtcagagagagggtgctgttgccccacccatggtggcttttcttttacatcacctgacacagaggctgaggtgggaggatcacttgagccaggggaggttgaggccgcaatgatctgtgatcacaccactgcactccagcctgggcaacagaatgagaccccgtctcaaagaaaaaacaacagtggaaaggaaatctgcagagaacaataaaagcaaaattgtggactccttgaggattttttcacaaatgcttctgtctttagttatggctgccattaaatgtaatttttttttcctcaagaaatttttctgagcttggtgttctaca

SEQ ID NO: 39007 - DNA, 318 bp, Homo sapiens
gagacagactctcttgcagccaccccaggctggagctcaactgcagccttgaggctgaggtgggaggatcacttgagccaggggaggttgaggccgcaatgatctgtgatcacaccactgcactccagcctgggcaacagaatgagaccccgtctcaaagaaaaaacaacagtggaaaggaaatctgcagagaacaataaaagcaaaattgtggactccttgaggattttttcacaaatgcttctgtctttagttatggctgccattaaatgtaatttttttttcctcaagaaatttttctgagcttggtgttctaca

SEQ ID NO: 39008 - DNA, 440 bp, Homo sapiens
cggcaaaatttgttattttgtagtgacaaggccttgctatgttgcccaagctgctctcgaactcctgggcttaagtgatccacccgcctgggctctaaaagtgcagagattacaggcgtgagccactgcacctggctagtggtacttttagatgtgatttgacatttaaatcagtagaccttaagaaaaaaagattaatctccataatgtacatggccctcatccaatcagttggaaaccttattagcaaaaactgaggttccccgacatagaaggaattatccacagaactaccacatgaaaacccattgggagatatacctaatgctagatgacgaattagtgggtgcagcgcaccagcatgtcacatgtatacatatgtaactgacctgcacattgtgcacatgtaccctaaaacttaaagtataataataataata

SEQ ID NO: 39009 - DNA, 280 bp, Homo sapiens
acttaattcataggcaaaggtaatgaaaatttctaagatgtctctgaatcctcctcacagacaaggagccttggctgggcacagtggctcatgcctgtaatgcccgtactttgggaggccaaggcgggaggatcgctggagcccagaagattgagaccaacctgggcaacatagtgaggccctgtctctacaaaaataaaattaaaaaataaaaaactagctgagacatggtagtatacacctgtggtcccagctactcaggaggctgaagtaggaggat

SEQ ID NO: 39010 - DNA, 442 bp, Homo sapiens
gagattgtcccctttccacttgggtggtcctctcacggaccgggcatgagctgttatggtagctctcttccaaaaccccacagcctggggtgatgagtgatggaagactctttcactgctgttccctgaggttaagagccctgcgggtcagcccctgaggtccatccagcctccagcccctggtgtttacttcacctcctgcctttcatggcagaggaaaaagttagcattccttggagacttaacagggtgcagtgaaaccaagccttttcaagaggttacccatcagtctgcccttgttcatccccgagcagatgtgtagtggtattgcaggggactattgctgggtactctgccaagtaattaaagcagcactcatgctttagtccaattggccatccctttcaccctagcattccgtcaacacgattaaaaaaaaaag

SEQ ID NO: 39011 - DNA, 453 bp, Homo sapiens
tgggcatctctgtgttgccgctaaagagccgtttgtaccagaagatgctgacagggaaaggcttggacgggcttcacgtggagcggctccccatcatggacaccagcctgaaaactatcaatgatgaggcccccacagtggctctctccttccagctgctttcctctgagagaccagaaaacttcttgacaccatcgggtcccccagagactcatagagtatccagggcagtgggtatgcccctctcccttacccatcccactctgttccaggcacgccatccctccttgttcctgactcttgactacgtccttgtttatcctctcacctctggttcggtctcctcctccatccatcacctgagactaaagagattaataaacgagactcataactcagctgctgggatgcagcagatatttacggctccgtttcaatttgcagagagattaa

SEQ ID NO: 39012 - DNA, 454 bp, Homo sapiens
aagctgtgtgaccttggataaatcactccacctctctgctcctgtctcctcattgttaagtagagggaacactgtcaccctgtccacctcttgagactatggggaggattaacaagagaatgaggggcaatgtgttggaaactgtaaagggctgtccactttgcaggagacttaatagtcactgtgttcctggggccctgcgatcaaggcggagaataaaaaggaagcaaaaatcccccaggcctctccctctgaccctttctccggcagggctgttcccagacccctgacccacttctcctccctccttcccccatccctccgagtctcagcgggccattctcctcctccatccatcacctgagactaaagagattaataaacgagactcataactcagctgctgggatgcagcagatatttacggctccgtttcaatttgcagagagattaa

SEQ ID NO: 39013 - DNA, 533 bp, Homo sapiens
ggtactgggggttaggacctcagtatcttttgggtgagacataactcaacacataatagcatgcaacatgaggattgaaataaaaagactaatttatggagtttttctcatttaattggaaagactgggccacatttcttgacacttaaaggcagcagtgggatattgaagtatatggaactatagtctatgtatgaggtcttctgctagaaaataggatttattaatatcccaagtgaagatctaacctcagtttttctagtacattttagtatttcccagatttgatgtgcttttaatccattcttcagtaacatttaaacttaaaaatataatcaaggatatgaactcctttatgaaattaggagctgtttacccatttgtatttggatactttaagcatttcaatctacttgaagaaactaatttttttttagccaagataaaataatttatttgaaaatcaaaatgtggccgggcacagtggctcatacctgtaatcctagcactttgggaggctgaggcaggtggat

SEQ ID NO: 39014 - DNA, 415 bp, Homo sapiens
gatccaatatttaccagcctgtgatcttggggagagattttcccagctgtggtcaaggagagatgtgatgagggaagaatggtcagagagatgctgcactactggctttcaagatagaggaaggggccgtgaaccaaggaatgtggatggcctctagaagctggaaaaaggcaaggaagcagattcttcccaacctaaagaggaggaacacagcctgccaaacaccccagctttagccctgttaaacctgtgttaaacttttaacctatagaactgtaatataacagatttgtgttgttttaagctgttaagtttgcagtaacttgttacagcagcaatagaaaactaatacattctgatggctaacactacatatgcatgggaaaatgtctaaaagaatgtattctccaatgta

SEQ ID NO: 39015 - DNA, 685 bp, Homo sapiens
aatttatctggttattcacatttctgaaaatcacttacttaagtcaaatatgaataaaacaatgactaaatgtattttgtcagaaaataatagtttatgaaataatagattagctatcactttctgcaaataatgggtttctaatgtttgttgacttaaattcatatattgaattaaatttactagtgaaatatcagatcatttaatagtcatttgtgatatcttagggtaataaaattttaaaatatgtatatgtttttgattgaacagacacaacatgacaatctaatgattaagaagatatgggtcctacattttgggtctttccagtattgtcaacagtgtaggagttttcgatgggaaatagccatagtcatcaaaaatccatttatttagttttaaaatatactaaaatattttcattgtaatgtggagtacatctgcctcttaagtttgtgtatattaataattgtatcctcagtgctttgcacatgaaaggcattcagtaaatgtttgttaaataaatgaataaatacagtaaggctactcagtgaggcctgctttccagattctgttctgacgccctcttttcaactcttcagttcatcactatttgctatgagcctcttcaagacaagcatcttgacctagcatcaacctaaacagatttgtctgcccttcctcc

SEQ ID NO: 39016 - DNA, 1929 bp, Homo sapiens
  misc_feature (1867)..(1867): n is a, c, g, or t
gaacggcccaggcaggggccttactagtaagcacgttttgggaagtcctcagggcacgcaggcaccgtgacctcacacactagtgcgctggagtgtgtcattagcatctggaatctctccccagggatgtggtttttgtttgtttttttttttttttttggtattataatgagctaaaagctattcaggggcgagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttgattacctcttggtttgacttcccagggtcttgggatgggagagtggggatcaggtgcagttggctcttaaccctcaagggttctttaactcacattcagaggaagtccagatctcctgagtagtgattttggtgacaagtttttctctttgaaatcaaaccttgtaactcatttattgctgatggccactcttttccttgactcccctctgcctctgagggcttcagtattgatggggagggaggcctaagtaccactcatggagagtatgtgctgagatgcttccgacctttcaggtgacgcaggaacactgggggagtctgaatgattggggtgaagacatccctggagtgaaggactcctcagcatggggggcagtggggcacacgttagggctgcccccattccagtggtggaggcgctgtggatggctgcttttcctcaacctttcctaccagattccaggaggcagaagataactaattgtgttgaagaaacttagacttcacccaccagctggcacaggtgcacagattcataaattcccacacgtgtgtgttcaacatctgaaacttaggccaagtagagagcatcagggtaaatggcgttcatttctctgttaagatgcagccatccatggggagctgagaaatcagactcaaagttccaccnaaaacaaatacaaggggacttcaaaagttcacgaaaaaattgaattaaaagataaaaattaa

SEQ ID NO: 39017 - DNA, 1196 bp, Homo sapiens
gaacggcccaggcaggggccttactagtaagcacgttttgggaagtcctcagggcacgcaggcaccgtgacctcacacactagtgcgctggagtgtgtcattagcatctggaatctctccccagggatgtggtttttgtttgtttttttttttttttttggtattataatgagctaaaagctattcaggggcgagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttga

SEQ ID NO: 39018 - DNA, 1222 bp, Homo sapiens
gaacggcccaggcaggggccttactagtaagcacgttttgggaagtcctcagggcacgcaggcaccgtgacctcacacactagtgcgctggagtgtgtcattagcatctggaatctctccccagggatgtggtttttgtttgtttttttttttttttttggtattataatgagctaaaagctattcaggggcgagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttgaaacaaaaaaaaaaattctccagcgct

SEQ ID NO: 39019 - DNA, 1164 bp, Homo sapiens
gaacggcccaggcaggggccttactagtaagcacgttttgggaagtcctcagggcacgcaggcaccgtgacctcacacactagtgcgctggagtgtgtcattagcatctggaatctctccccagggatgtggtttttgtttgtttttttttttttttttggtattataatgagctaaaagctattcaggggcgagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgacagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttga

SEQ ID NO: 39020 - DNA, 996 bp, Homo sapiens
gaacggcccaggcaggggccttactagtaagcacgttttgggaagtcctcagggcacgcaggcaccgtgacctcacacactagtgcgctggagtgtgtcattagcatctggaatctctccccagggatgtggtttttgtttgtttttttttttttttttggtattataatgagctaaaagctattcaggggcgagttatcagaggtgagcccgtgctcttcagcggagaagatcccctacctggccgccggccactttctgtgggccgtggggtcctcaaggagacggcccttgggctcaggggctgcgtttccacacgcgcctttcccagggctcccgcgcccgttcctgcctggccgccggccgctccaacagcagcacaaggcgggactcagaaccggcgttcagggccgccagcggccgcgaggccctgagatgaggctccaaagaccccgacaggccccggcgggtgggaggcgcgcgccccggggcgggcggggctccccctaccggccagacccggggagaggcgcgcggaggctgcgaaggttccagaagggcggggagggggcgccgcgcgctgaccctccctgggcaccgctggggacgatggcgctgctcgccttgctgctggtcgtggccctaccgcgggtgtggacagacgccaacctgactgcgagacaacgagatccagaggactcccagcgaacggacgagggtgacaatagagtgtggtgtcatgtttgtgagagagaaaacactttcgagtgccagaacccaaggaggtgcaaatggacagagccatactgcgttatagcggccgtgaggagatcttcagggctcgtgaattctgattccgcccagcagtcactctccagcccttcggtatccacgaagttggtggggtgctgaggtgatgcttcagactcagtgtggcccacatcgactttataacttaatatggcaaaatgatttgtacagtgatgtataagatga

SEQ ID NO: 39021 - DNA, 425 bp, Homo sapiens
gtgtcaggcattggaattgcgtgattgccttctctcggtctttattgcctattagaaatatttccacgttttttcatggttgcgaagcagtgctccgctggttgtgcagcgatggagagacccaagccagaggagaagcggtttctcctggaagagcccatgcccttcttttacctcaagtgttgtaaaattcgctactgcaatttagaggggccacctatcaactcatcagtgttcaaagaatatgctgggagcatgggtgagagctgtggtgggctgtggctggccatcctcctgctgctggcctccattgcagccggcctcagcctgtcttgagccacgggactgccacagactgagccttccggagcatggactcgctccagaccgttgtcacctgttgcattaaacttgttttctgttga

SEQ ID NO: 39022 - DNA, 535 bp, Homo sapiens
caaagtcctcagaggccagagagaggtgtaggaactgtgctagtgtaaggcagtgcctgctacagtgggtccagatgaaatactgggaggtaggaagaaaatctggatttcatatcatccatttttaaatgaaaaattaagctttaatagtgttaaatgcgccacagagaacagtgtctatgtcactcttacaagagatgcacaaaaccaaggtgtacagccttcaagtgtgttctcaaaggagggtgcatgccttaaaaattgtggagaccactgctctgtcatctgtgattcccctgaaaacctctgggtacatgaagccctccccaaggggaatctggacacccagcacattctgcccacagggagatcttcagggctcgtgaattctgattccgcccagcagtcactctccagcccttcggtatccacgaagttggtggggtgctgaggtgatgcttcagactcagtgtggcccacatcgactttataacttaatatggcaaaatgatttgtacagtgatgtataagatga

SEQ ID NO: 39023 - DNA, 829 bp, Homo sapiens
cgcccagaagctcctgctcagtaactacagacgcgaagctcagcctctcggtttgggaattttcttggaggccgaggccctgcgcctctgtctgcacccaaggcgaccgcccagcttacccccggctcttctgagcacagggaggcctcccagcaaagcctgaaccctctaagtttagctgcaggcttcgaaccccgaccgtccccgccgagccttgggctgctgaggtggggatgaactgggcgaaagacacttgggagttaggaagaaacaaacaagcagggaagtgaccaggagacaaggtgagactttgcccggctcaggtctgaactgagtgttggagataaccacagttaacaaaataaacaaaattattcgcccccgtggagctgttagcaaccctggtgcctgggaagcctggaagaggctcgggttagtaacaacctccaggatgccctccgaactggtactggcgccgggactctagacaaggtccagattcccgggcccttccccttacgggtgcaaaaagggagggtcaggacctgccagtcctggcttcaggatgttgactggacggacctggactcatgggaactgtgcgccaaagtcctgggagcaaagtgtcataacgctcctcgtttgtctcttgccttcacaggagacagccctgctgcaagcggccagtgggaatccttggcctttgggggtatgatccaagaatgtaaacgctagcttttcagtgttttcgatttcgtgatattcaatgcatacaatacaatgtgactcttgaagcttaataataaaattatcattcttgagcccagca

SEQ ID NO: 39024 - DNA, 408 bp, Homo sapiens
gttgctatgaaagattctcatattcactgctttcaaacgcaaaagttgttcatcctaaactcaagtgtgaaacttttaatttaatttaattaattaattaatttttttgtgagacagagtctcactctgtcacctaggctggagtgcagtggtgtgatcttggctcaccacaagctccgcctcccaggttcaagcgattcccctgcctcagcctcccgagtagctgggactacaggtgcccgccaccacacccagccaatttttagatttttagtacagacggggtttcactatgttggccaggctggtctcaaactcctgacctcttgatctgcccgccccagcctcccaaagcgctgggattacaggtgtgagccaccgcgcctggctgaaacttttaattttaaa

SEQ ID NO: 39025 - DNA, 392 bp, Homo sapiens
ggctggtcttgaactcctgacctcaagcgatccgtctgcctcggcctcccaaagttctgggattacaggcgtgagccactgcgcccagcccattattatactttctgacaaaatgtatatatgtatagtcctgacagcctgaggtggaagaaaggtagttaacttagatacaaataactgcttgcccatttaggaatctaagactaagcaattaacattctcacatgtatctccctgcacatgtgtacacatatctgagaagtgcctggtttggttaactgtcttctgatcagaatccattacttactaagccaggcacagtgttgtgtacctgtagtcccagctacttgggaggctgaggtggggagatcacttgaccccaggagttcaaa

SEQ ID NO: 39026 - DNA, 439 bp, Homo sapiens
gccccaaatgacagctccggctcgagctttggcggcgcccaggcaattcccaagacctggcggcggagtctccccctgcggcagattctcggcagaatcacttgaacttttcacgaagttcttagaggggcaagatgcgaaggaaggaaccaaggagatgttttctctcagcagctgcatcccgcttcttctttgccatagatttatttttaaggggcgtctggtagataaagccctagaccttgtccacactctcacccccatccccaactttccctggaccggtgccgcccccacttgatgcttgctcaaggccggggactggagcgggctacttgtatatttcgttgtcagtctgcagaatgtgtttgatttttatttttccctccttctctgacatgtgtcaaggaataaagactggatacaggtccattacgtc

SEQ ID NO: 39027 - DNA, 460 bp, Homo sapiens
aacaggttctccatcccatagtgcctgtgacgggctcagataaaatcagcaggagtggctggtgctccaccgctggcctgttacagctggctcctggacagccgctcccccagcatccaggagggtcatggactaccacccaggccgtggcccctggaaccgccctacctaagctattgccagcaaggacaggcacttgagcaaaggcaacagtgtgctcacttatggtggggggagggatctggcgaggcatagctaggtcctcatgtccctcgtaggttcccaagcttggagtcagtgccacttcccactgtcctcatcccctgcccacctcttgcctcccaccaggctgtagcatagactgggcaacccctgaggatttctgggtcagcactaccctggcccaaagagattaaagagccaggggaccggagaggagaggaaagtttaaaaatttaaa

SEQ ID NO: 39028 - DNA, 412 bp, Homo sapiens
attatgttaagttattgtaaaacacagaaataataaaatttgtcagtcatgttcttgactaactaccttggacatttcaccattcaaaatcgtcttgttttaatcctctttaaaggatggtttataatcagctataggactttgacacatgctctcaaatgcaagtttctgataactttggagattatgacattggaataaaggaaaaatgtacaggactcatgaagagctaaaatattcatgaatatcaagcaaaacaagagttaacaaaatggactttttaacctttttgcttaaaatgttgctgatccttattttgtttttcagagtcaaggaaacttattttaagctatttatagcctctaataattatgtaaggtatacttctgtaaataaaattcagagcatattt

SEQ ID NO: 39029 - DNA, 347 bp, Homo sapiens
ggctctttaccagggatgcttcatataaaggagggagaacaatttccttgacaaccaattaatatgtatagcttaaggctatgactgtattctgcaagaaatagattacatttctgaggtctgcacatctgaagatattataaactagctaggagatttttatgatgatatgatacagatcagcaatacgtaagacagaaagggggtttcacccagcaagagttaggatttatagtcccagtatgcccgagttttacatattgtgaactttgctaaccttcacctttatcaacaagctgtgagtgactctccagcacaaagctttgagtatcaagcatgcatatagt

SEQ ID NO: 39030 - DNA, 732 bp, Homo sapiens
ataatattagaatgggtaacgcctttgtaagtcggtgattcaaaagatcaataaatctgaaagcacaaatataaaacatttatatttggtatcaataaataaataaataaagccaaaatacaaacaataaaatcttaagattatctgtaactcataagactgaaaagggctaacttctctataaaaagttctcttacaaatctttgagaagaccttccttactttctgcctcctccagacaaaactgggtaaaggattttaataggcaattcataaaagaagaataaagtagaggtcatataaaacaatatttaacctcactcataattaggaaaaaaaatagtaatttagcatttctttcatttaccagattgtcaaaaattttaaaatttgataataggcaatcatgtagacagtttaggacagtggacactgttgagcattattgactggaatatatagtacttatataacctttttagagggccatttgacaatgtctgtgaaaatcatgttctttatgacacggtaaattattctgcaaagaatgtgtcccatagatatattcatagaagtaggcatatatacacacatgcttatagtattaaataatagctgtgcatttattaaaaagaatacagtctggggcactgtgccatgcacctgtggtcccagctacttgggaggctaggaggctgaggcaggaggatagcttgagcccaggagttcaaa

SEQ ID NO: 39031 - DNA, 714 bp, Homo sapiens
ggaggcttggcagtctgataccatggtgccggcatctggtgagggtctcctttctgcatcagcccatggtataagagaaagagagggccaaatttgcttttataataggcccactcccacaataatgacattaacccatctgcttcttactagtgattaataatcaccacttattaggccccacctcctaacacttgcattgaggattaagcttccaacccatgaactttgggggacacattcaaagcatggcacgggcctagtgaaagactggactctttcagtagggccaaattcttgtatggatctgatagcaaaccaacttaaaattttgtttttaaatctcgcaagctttctttttttcttcctttctttccttccttcctttttctttcctttctttccctcccctcctctcccctcccctcccctttttttgtgaaagcaggtttattaagaaagtaaaggaataaaagaatggctactccataggcagggcagccaaatcttgtaagccttcttcagtttggagaaaatgagaaataaagaggaaggatattccaaaaaaataacatgccattctgaattgtttttaaaaattagggaattggccagatgcggggctgatctgtaattccagcactttggaagacttaggtgggaggatcacttgaggccgggagttcaagaccagcctgggtaacatagtgagac

SEQ ID NO: 39032 - DNA, 316 bp, Homo sapiens
taagtgggccatatgtgaactgtatctcaatacagctgttaaaaaaaaaaaatctttgagaggccaaggcgggaggatcacttgagcccaggagttcaagatcagccctggcaacacagcaagaccctgtctctacaaaaaattttttaaaaattagcgtggtgtggtggtgcatgcctgtagtcccagctactcgggaggtttaggcaggacgaccgcttgagcctgggagatcgaggctgcggtgacctgtggttgagccactgtataccagtccagatggcagagggagactctgtctcaaaaggaaaaaaaa

SEQ ID NO: 39033 - DNA, 398 bp, Homo sapiens
tcccaaacttcctaattggatcctctcaagcttgttacagtgctgaaaatcacaggtggtttacacaacagaaagatttctagagtgatgagaaagtgaggatgtgatattttgtcatgggttgagcataagcaacctgctaaaatgggttgccaaatgctacctatatcccaagagaaggaagtggaagtgatagtgtagctatataaataatgtgagaaaaaaatggaaaatagatctgaattcactgcagaatgtgggtcggggaaaaggtgaaattttagtggagtgaggaaaacatacatagataattgctataacatgaaatgtaattggacttgctttgcctatgaaatgagagtggctaaataaaaaagaattcagcctggttattagaa

SEQ ID NO: 39034 - DNA, 505 bp, Homo sapiens
tttattttggttcaacttgcttctggtttacacataaaaactgcgatgtcactgctgtaacttataagaaggggtgagcaggttcaggaaaacccttattacaaatctgagaaagcagttatgattacgagataaggatgcaatcccaggggaggttctaaatgtttccatgtaatctggacccaagcaaccgtcgtcaaaccactgttcatgaaatctgtgggtgcaaacaaattgagctgtcaggctgcaggacgcgagcaaacactggccaggcaaatggcatttcctccctccagcacatttctgctgctgacccgcctgctctaaggcccactgaaacctgacacccagaccagctggcctctccagggaacgggcctggcaccaaacgctccatctgttagcacacctcaagccacctggccactttgctctttttccctggttcccttacaggcaggagaatcttgttcctctgccacctgtaaactcacagagcctg

SEQ ID NO: 39035 - DNA, 770 bp, Homo sapiens
agccctgttcctgctccggctcctgcggggatggatgcttcacgcagtaagcgagtaagcgagccctggagaccggggccctgggtgtgcggtcggctcagtgccacgcggtgagataggcatggttatcaacccacgccaaggcggttgtgtacctggcatagaaaacactgctgttgaatgttgtttccatagtcattcgccagcgtccactgatgagaggtgccaccacggacacccggccttgctccgtcgaagctttggtccattaggaccaaagtcaggccccagcgggcctccctgccattcctggacggcctcgcgtcctcccagagcctgaccttctcttatctctgcagcctaagtcgcggaagcgtagacacccggcttttcccgcgtgctctatcgggctcccctggacacggagggtggagcagaaagagcagaggggccggtgggagccatggggagtccgcctagctccagaggacaccttacctggatccgcctttgtagcctcctcctggctctgggggctgtcctgtggggtcccgagtagctgaaagacagcccctccatgtgaggaagcccccaactggggaaaaccccctcgtggactcattcctgtccctgcatgtggccttcacctgactgtctgcattgaggcatcctctgccaagagcaatttcaaagtggcaggaaagtgctgctttcaacatctgccacatttgcaagaagagcaaaggtggcccatttgagaccacccttga

SEQ ID NO: 39036 - DNA, 1010 bp, Homo sapiens
agccctgttcctgctccggctcctgcggggatggatgcttcacgcagtaagcgagtaagcgagccctggagaccggggccctgggtgtgcggtcggctcagtgccacgcggtgagataggcatggttatcaacccacgccaaggcggttgtgtacctggcatagaaaacactgctgttgaatgttgtttccatagtcattcgccagcgtccactgatgagaggtgccaccacggacacccggccttgctccgtcgaagctttggtccattaggaccaaagtcaggccccagcgggcctccctgccattcctggacggcctcgcgtcctcccagagcctgaccttctcttatctctgcagcctaagtcgcggaagcgtagacacccggcttttcccgcgtgctctatcgggctcccctggacacggagggtggagcagaaagagcagaggggccggtgggagccatggggagtccgcctagctccagaggtaagggcgagaatggcttcatcctccccccttcatcctccaggccagcctcggacccagcagcatcctgcccagggggcacccccacctccctggatgccagccagagctggagaatattcacgacccagaggagggcctggactccagagaagggaccccctttcacagtgcactctgtgtctgtgtggatctgatttcatgtctagtgaccactatttttatcctcccaattcctaggacaccttacctggatccgcctttgtagcctcctcctggctctgggggctgtcctgtggggtcccgagtagctgaaagacagcccctccatgtgaggaagcccccaactggggaaaaccccctcgtggactcattcctgtccctgcatgtggccttcacctgactgtctgcattgaggcatcctctgccaagagcaatttcaaagtggcaggaaagtgctgctttcaacatctgccacatttgcaagaagagcaaaggtggcccatttgagaccacccttga

SEQ ID NO: 39037 - DNA, 914 bp, Homo sapiens
  misc_feature (468)..(468): n is a, c, g, or t
ctgggattacaggcgtgaaccactgtgcccggccttgatttgcctttgaactctctctttggcatctctttgggatagattccaaaatctttggtgtgggacctgaggcccttcacaggcagacactaagcccccttcagggtgccagttcagccctgctgtgtcctgggccttgccctgtggtgtgcccattgttgctggcctctgtcacttccatacactttatcttgcttggtatacaccattctgttcttgtccatctggggaatccgttggtccttcaagttctggctcacaggttggcccctctgaagcctcttggcatcgcctggaattctgtgagtacttgctgcacttggccgctgtggccgggtgtgctgctgctacgggcttacatgcctgtccccactggccttcactttctgtgcaggccagggactggagctgtttaaatcccagctccaagcnacagtgccctatggcagatgctcagtaaacgctgagctgaagtgaatctgtgtatttcagtaagagaaaaaaaaaagagctgaggatgcagccggtgaccggaatgtgaattgggctctattggtagtgtacccgaggtagattatttgtactcattgagtctttatcttacctgtaaactgatgagaacagtgtatagttcattgtcaggaaatatgcagagttacagttgagctttgttggaaaatttaaaaaagtggaaatgagaaaacattttaagctgtaagatagcatgtgtgtataaactagtattatttgtaggaaaatatgccaaatagaatgaagtataggcttcctcagtgggacactggattttcagattgcttctaaaatgctgtccttgacgtgaactttccatgttatccttttttttttttttttttttt

SEQ ID NO: 39038 - DNA, 209 bp, Homo sapiens
tgatacgaatcagctcggtaccctcgataagggcaattttaagctgtaagatagcatgtgtgtataaactagtattatttgtaggaaaatatgccaaatagaatgaagtataggcttcctcagtgggacactggattttcagattgcttctaaaatgctgtccttgacgtgaactttccatgttatccttttttttttttttttttttt

SEQ ID NO: 39039 - DNA, 547 bp, Homo sapiens
tctcccttgctaatatctagatttttttagtacctctaatactaagagatttttaatttctttgctatacttctgtccttttcttctctattcatgctcaaaagaaagtaagtgctataactactcttttttgtttgcttaaaaaatgactcatgaacttaaggtacttaagtatggacactcctgacaactaatacccatagcggagaactactgagttaaagggtacccagtgcaaatagagggctgaaaacaaggaaggtcagtcagtgaatgggaaagaaatatgacaaagcctaggaaagggagctcctctagcatcaaactgtctgcatgtcgagtctcagaaaaacaaggattcgtcagtcaacccctttctgcatgcacagtggatttagggtaaagtttatgttaccctgtctttggccgagcgcagtggctcctgcctgtaatcccagccctttgggagactgaagcaggaggattgcttgaccacaggagtctgagaccagcctgggcaacatgacaaaacctcatctctactaaa

SEQ ID NO: 39040 - DNA, 513 bp, Homo sapiens
ggttaaaagcccagagaagaccgccaggggcgcgtggaaatggtgtccctcgtctccaaggcccagacggagcttagcttcctcttgaaggagccatatctgtatttctggtgaacgtcgtgtttgacatcaaaggaatgtttagagacatgatttcagccttccttacgcagagaatgctcatcaaaaaataaaatggacacaccatacactgacgtcactcagatttctatggctggaagttaacaaatattgttttcaaatgcgtgtagcctgatgctccagagttagtttggcgagcctcagcattttctgtcaggcacaagaaagaaaagactccagacaccatgatgtggaacgtggagtggggatgtttggtggccttgaatgcctattccatattgttatgcaggctggatgtgatggctcatgcctgtaatcccagaactttggaaggcctaggcaggtagatggcttgagctcaggagttcaagactagcctgggcaacatgg

SEQ ID NO: 39041 - DNA, 329 bp, Homo sapiens
gagccaccatgcccagcccttggtaataactattccttaatgtgttttatcacagtttaaactccttaccctcctctgtcgtgctccccacacccctggtcatgagatatatttgaaatgggagccacgggcaaggggtctttgtatgtctagccctagtgtctcgcgcatagtaaaaggataaagaatatttgttttgactgtacctgagtagttcacatggaaattactgaagccctgtggtgcgtatgtgttaagtaatactgctgccacgactgtttatcaaacatgtatggggtgagatattacttttacccaggagttgctcc

SEQ ID NO: 39042 - DNA, 395 bp, Homo sapiens
ataggtgtgagccactgcctctggcccagttgaagtgtttcaaaagtcctgtagctcatgaagatccgagcctgaaacagtgaagtaagaggatttcttccataatgtagaggagataactatagtgtagagaagttcattagacttctttttacctgaagaaactacttgtgcgtttttaagttaacacctaaatttctaaattacaagttgaataattgcataagatataatttggatgtttggtattgacatttaaaaataaagtggttgcattgctcttttaaatgtatccagtgaaatctaaataccctagcaattggatacttgctttcatctcttttttaaaaaaaaatgctaaggtgcaagatgttggtgttacaaagtactcttaa

SEQ ID NO: 39043 - DNA, 304 bp, Homo sapiens
gaagtgagagaatgactagtttctggcagtgtgacaccatgagcatgctcctaggctaatggagcagatggaagagctccctccaagagaggctccctgcagccctccccttttttcttctgaaaatgtgtgtctttcttttcaagccacgacttaaagtcttattttgttcctactcttagaaacagtcaaaaagagccccataccgtaccggccattttatgaatcaatgtaattttaatgcagagggatagtaaagcattatttgtctctccggccttggttccttttctgcatactgcaa

SEQ ID NO: 39044 - DNA, 367 bp, Homo sapiens
ttggatattgggatataggaataagatgtggatactctggattctatcatatagttccaaagagtgttgagtttcgtgttttggtagcttagttggaattagtttttttggtttttctgtttttatttttatttttttgtagagatgaggtcttgctatgttgcccagtctggtcttcaactcttgaactcaagcgatcctcctgactcggcctcccaatgtgctgggactacaagcgtgaaccactgtgcctggcttcttgctgatttacagaccatacatgcacccccagcaaaagatttaaaaactaatcttcagccagggcaacacactgagaccttgtctctaacaaaaattagctgggtgt

SEQ ID NO: 39045 - DNA, 456 bp, Homo sapiens
gcgtcgacctaaataacagaagaaaaaccacaaatgatcaaaatagaaaaaagatgctaaaccttaccaaaatgtaaataatgaaaacgcacacaaaacctttttcaatgatcaaattggtgaaactggtaaagactgcttatgcaggagtggactctacagagaaagtctaattcccaaatgctggccgggtgcggtggctcacgcctgtaatcccagcactttgggaggccgaggcgggtggatcacgaggtcaggagattgagaccatcctggctaacacggtgaaaccccgtctctactaaaaatacaaaaaattagccaggcgtggtggcaggtgcctgtggtcccagctacaaggaaggagaatgatgtgaacccgggaggcggagcttgcagtgagctgagatctcgccactggactccagcctgggtgacagagcaagactccgtctc

SEQ ID NO: 39046 - DNA, 318 bp, Homo sapiens
ctattgcacctcttcatttggaagattttaaaacaaacaggacaattattttaagttgcacatattagagttcttaaaaaagaggctcagtgtttttgacaacaaaatcatgtaacaatggaaaaacatttcccaacatcacttttcttcatgtaacatggatttctttcatatagtaattattttctcatcccttttttaaaaaaagaataaagttgtagagtagaggaagtaagcatttcatttaacctaaatatgtatatgagcctgtttctgtgcatacagcaaaaatttaataaaacaatagctttgccttta

SEQ ID NO: 39047 - DNA, 467 bp, Homo sapiens
agtgcacaagctttccccagcaagaaaaataacatgtgtgtgatgtttctagagaaccccattagagattcagaacccaaggtttttactgggggctggtcacgtagacaccttcaacctgacatgtaccaacatttcatactcccagaaggagagcaggtattcagcataaaccacattgtgtgtttaaatgttctaggtcagtgagccacctttatcacgtaggggaagtttttttttttttaaatcagtgtaagaaactttaccagtcaaattcccaggtcctagccaaaggccagtgttgcaagcatgcctttttgaaaatagtaatagtcacactaggtgtagtggctgatgcctataatcccaacactttgggaggccgaggtgggaggattgcttgaggccaggagttcaagaccagactgtgtaacataacaagacctcatctctacaaaaaataacta

SEQ ID NO: 39048 - DNA, 391 bp, Homo sapiens
agagattatttggagacataatggccaaaagcttcccaaatctgatgcaagacataaacataaaaatccaagaagctcaatgaattccaaataggatgaactcaaagagatccaccccaagacacaagacacagtatactcaaactgttgaaagacaaagagagaatcttgaaaacaacatgagagaagcaactcattatgtagaaggaatcatcaatacgattatcagaattattgtcagaaatgtaggagtccagaatgcaatgggctgacatagtcaaagggctacagaaagaacaaaacaaaacaaaaaaaactgccaaccaagaatcctacattcagcaaattgtccttcaaaagtgagtaagaaattaaggcattctcatattaa

SEQ ID NO: 39049 - DNA, 828 bp, Homo sapiens
cagctacttttaaaaatattgaaataataaatacattttgaatatacatgaactatagtcaccttcttgtgcaatagaacaccagaacttattcctcctatctacctgtaactttgtaccccttggcaaatgtctttcctttctctgtccccactccccaaccctaccacccagcctctggtaaccaccattctactctctacttccttaagtttttagatttcatgtataagtgagatcatatggtatttgtctctctgtgcttgtaaagccctaactttttgagcaatttttttttaccctggaataataaataagttttgtttatttaagaagaaattactccagatttattctaccctaggtatataccccaaagaactataaattgaaaagaactataaattgaaaaagcacttgtgagttttaatatatttggtctgaactaaaagtttacgaatagaatttcgcttgctttcaaatcaaagtatcagcttcagtagataatcctatgattagaattacttctaacataaagttttatgtttctgtttgtgacagagactaccagttgccttccaatacatttttttcttcttccttagtaacaaaccttaggaaatgtgtctagcttttagtcttttagactacattttctggccattcttaaagcaagatgtagccatgtgaataattctggtcaataagaagaaagctgaagtgttgtgtaggattctaggagggatcctcccttctgctgctgaaatgaggatgccatggttagaaatcaaacagtcatcagagaacatgaggaagtaagtcagggcc

SEQ ID NO: 39050 - DNA, 238 bp, Homo sapiens
atgtccctactgaagggagaggagaattgagtgttatgaatccattgaaatgtgtgccctcactccagcatgatgatgatttgcatgtttctggttttgcatcagaagctgctctgaaggtgcacagaaaagcagctgtatgagttagagtcccgatgtttacccaagggcagcatgactaggggccctacctgctctggcagggctgtcagagacacatttcacttctgggaggagg

SEQ ID NO: 39051 - DNA, 4573 bp, Homo sapiens
tagggaattcggctgaggctttgccggcgcggcgaagaaggtggcaggcggcaggctgagctccactggacacagcctagtggcccggggcgcgcccgctgcactcccggcgtccaggtctggcgcaccgcgggaggcaggcgcgctgccactctccgcagccgcttcgtcccctggtctgtctcgcctcggcttcagcgggcaaacccacagctggtctcctgggcgctgatctccctgcaatccttgcttacataaggcgggcgggcgtgctcccgcccccggttaccccccagaggagttgtgctgcgccctctacgcctccttggcgagcgccttcgcgcacccgtgcgccctactctaggatgtgaacctccttggccacccagcagcgacagccgggacatctctccgccggcgtgagaacactgagattggagaccagagcgcctgacggtgcccaagcttcctccctccgttccctcctcctccaactccccccacttcaacccccacccccacccccacccccggtgtctgtgtgtgttcctcacaggcgaggggacccggagagcagtccagacttcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagcctgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcatatctacggaagacatttgagcaggaacccctaggaaaggaagtgtctttggaacaggaagtcttactccagtgtcgaccacctgaagggatcccagtggctgaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatgtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagactgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtctccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggagtcagcttgctgattcccgctggggccattccccaagggagagtctacgaaatgtatgtgactgtacacaggaaagaaactatgaggccacccatggatgactctcagacacttttgacccctgtggtgagctgtgggcccccaggagctctgctcacccgccccgtcgtcctcactatgcatcactgcgcagaccccaataccgaggactggaaaatactgctcaagaaccaggcagcacagggacagtgggaggatgtggtggtggtcggggaggaaaacttcaccaccccctgctacattaagctggatgcagaggcctgccacatcctcacagagaacctcagcacctacgccctggtaggacattccaccaccaaagcggctgcaaagcgcctcaagctggccatctttgggcccctgtgctgctcctcgctggagtacagcatccgagtctactgtctggatgacacccaggatgccctgaaggaaattttacatcttgagagacagacgggaggacagctcctagaagaacctaaggctcttcattttaaaggcagcacccacaacctgcgcctgtcaattcacgatatcgcccattccctctggaagagcaaattgctggctaaatatcaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggaacctactggcatcgatttgccgctgctggatcctgcgaacaccatcaccacggtcacggggcccagtgctttcagcatccctctccctatccggcagaagctctgtagcagcctggatgccccccagacgagaggccatgactggaggatgctggcccataagctgaacctggacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccgtccaggtgaatcacagctgaggaggaaatccagatgagaccaatgcacttcacaggcaagaatgcagcaggagccagaaggaaaacagatacaactgcccatgtacatgcccactttactcggagatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcagataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctat

SEQ ID NO: 39052 - DNA, 502 bp, Homo sapiens
atttttgagatgggggtctcattctgtcaccaggctggagtgcagtggcgcaaacacagctcattgcagcctcagtctcgcaggctcaggtgattctaccaccccagcctcccaggtagctgggactacaggcatgtgccgccatgaccagctacttttttgcatttttttgtagggatgtagtttcaccatgtcaccgaggctggtctcaaactcctgggcacaagcgatttcgcccacttcagcctcccaaaatattgggattacaggcgttagccaccacactcggcccatatttggttttgaggataagttgggaacactttggaatcttttcagcagaggaactcatgacctgacatccattagcagagtcatcagagtcatctggctgctgtgttgagaatggaccatgctgggcaaggggagaagcaggaagaccagtgatgagactgcagctatgagagatgttaagctactgtagattggaagcagtggaggt

SEQ ID NO: 39053 - DNA, 1980 bp, Homo sapiens
tagggaattcggctgaggctttgccggcgcggcgaagaaggtggcaggcggcaggctgagctccactggacacagcctagtggcccggggcgcgcccgctgcactcccggcgtccaggtctggcgcaccgcgggaggcaggcgcgctgccactctccgcagccgcttcgtcccctggtctgtctcgcctcggcttcagcgggcaaacccacagctggtctcctgggcgctgatctccctgcaatccttgcttacataaggcgggcgggcgtgctcccgcccccggttaccccccagaggagttgtgctgcgccctctacgcctccttggcgagcgccttcgcgcacccgtgcgccctactctaggatgtgaacctccttggccacccagcagcgacagccgggacatctctccgccggcgtgagaacactgagattggagaccagagcgcctgacggtgcccaagcttcctccctccgttccctcctcctccaactccccccacttcaacccccacccccacccccacccccggtgtctgtgtgtgttcctcacaggcgaggggacccggagagcagtccagacttcggcgtgcggcggagctgcggctgctcctgctgctggggggagcggcggaggtggccgccttgcgcctccctggacttcccaagtgggggcagagcagtcgctcgcgggagacgtcagttagaaggcattgggaaagagggaccttcaaactcctcctcggcgtctcctctcctcccccttttggcccctgcctttggagaaagtggagtgtggcgcttggttgtcgttatttcttcggactgcttcgcggtgcacggattcagcttctgcccagtggggctttcagctgtttgcgcgtctctctgtccccctcccctccccccggcacacctctgtctacgatgaggaaaggtctgcgggcgacagcggcccgctgcggactgggactgggatacttgctgcaaatgctcgtgctacctgccctggccctgctcagcgccagcggcactggctccgccgcccaagatgatgacttttttcatgaactcccagaaacttttccttctgatccacctgagcctctgccacatttccttattgagcctgaagaagcttatattgtgaagaataagcctgtgaacctgtactgtaaagcaagccctgccacccagatctatttcaagtgtaatagtgaatgggttcatcagaaggaccacatagtagatgaaagagtagatgaaacttccggtctcattgtccgggaagtgagcattgagatttcgcgccagcaagtggaagaactctttggacctgaagattactggtgccagtgtgtggcctggagctccgcgggtaccacaaagagccggaaggcgtatgtgcgcattgcataggaactcatgacctgacatccattagcagagtcatcagagtcatctggctgctgtgttgagaatggaccatgctgggcaaggggagaagcaggaagaccagtgatgagactgcagctatgagagatgttaagctactgtagattggaagcagtggaggtggtgaggccaggatttcagatatatttaaaagtagagataacagcttttgttgagaccttggatgtgtgatgtgagagaaagaagagaaaggatgatttgaaagggctaagccttatcaaggatttctttcaaatgtctttagtgaagccattcctgcctcacagagggaggaggctgggcattcctttctcaatactttcagagcagtttgtccatacccctaatatagtgcttgtctcatttcaattatattcactcgtaaaatttgtgtttcatgccagtgagttccatgagatcaagaattctattgtacttaattttatatctctcctgcttagcacaatacctagagtatcacagatgtttaacaattttcttgaattaaaactgttataaagaat

SEQ ID NO: 39054 - DNA, 2375 bp, Homo sapiens
acagtcacttactctacaggcagtggggcccgacacagacagcgccgcccccgccagccagcctcgcacgccctcggaagcgcaggctcccggcgctgcgctggagggttccccggcaccccagcctcccgtccccagcccgctgcacctccgggccccccttacccttgagaggcaccgggagttgtcgcgggggggcctcgggaaattccccggacccctgtgccaggaggtgcccggttcgcccgctcttcaccccccgccccccccgagggcggtgcccgggggtgctgccccatggagcggggaggcgggcgccgtctgctccgggagccctgacccgagtcggagctgtgtgtcgcagccgccccgaccccccgccgatcatgcgccggcgcccctggctctccagtcccactgggctgtgagccccccactcccagcccgtcagggcctgcgcgccatgggcagcgcccaccctcgcccctggctgcggctccgaccccagccccagccgcggccagcgctctgggtgctcctgttcttcctactgctgctggctgctgccatgcccaggtcagcacccaatgacattctggacctccgcctccccccggggcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggtttccgagagagcgcttttgcctacgccatcgcagcagctggcgtggtgcacgccgtgtccaatgcgtgtgccctgggcaaactgaaggcctgtggctgtgatgcgtcccggcgaggggacgaggaggccttccgtaggaagctgcaccgcttacaactggatgcactgcagcgtggtaagggcctgagccatggggtcccggaacacccagccctgcccacagccagcccaggcctgcaggactcctgggagtggggcggctgcagccccgacatgggcttcggggagcgcttttctaaggactttctggactcccgggagcctcacagagacatccacgcgagaatgaggcttcacaacaaccgagttgggaggcaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgctgcggccgcggccacaacatcctgcgccagacgcgcagcgagcgctgccactgccgcttccactggtgctgtttcgtggtctgcgaagagtgccgcatcaccgagtgggtcagcgtctgcaagtgagcggcccggggtcccctgggccctgatcgaggtcccctcctggagcctggccctctgaggcttacggtcttggcaaggcagcatcgccttggctcttgggaagaggagattggaccacatgatcttataggaacccctcagctctgaggtctgtgatcgccggacagtccaggcctgtctgaaccccaccactcacttctgtgggctctaggactgactgggttcttcctccctccccgaagcccagacagttcagttgggctgggggttgctccacaccctaaaacaagcctcagccaggcaacccgtcagtctgtctccatcctttcaccccttccctggagatgggaggtggggaatgaatggaagctgacgggcagagagaggaggattaaaaaaaagaaatagacataactgagctgaagtaattccataaagggcccagacagcctcctccaccattcccttcatcattcatttaacaaatatttattttgcactctctttgcggcactctgggggcggtggggtgcgtgggggtggcaatgcaaggcactgaggccacagatgtgagtaagcgagacacaacacttgtcctcttggaggttacattcttgctggggggaggcatgggcaataaacaagtaaatatacaaac

SEQ ID NO: 39055 - DNA, 2110 bp, Homo sapiens
acagtcacttactctacaggcagtggggcccgacacagacagcgccgcccccgccagccagcctcgcacgccctcggaagcgcaggctcccggcgctgcgctggagggttccccggcaccccagcctcccgtccccagcccgctgcacctccgggccccccttacccttgagaggcaccgggagttgtcgcgggggggcctcgggaaattccccggacccctgtgccaggaggtgcccggttcgcccgctcttcaccccccgccccccccgagggcggtgcccgggggtgctgccccatggagcggggaggcgggcgccgtctgctccgggagccctgacccgagtcggagctgtgtgtcgcagccgccccgaccccccgccgatcatgcgccggcgcccctggctctccagtcccactgggctgtgagccccccactcccagcccgtcagggcctgcgcgccatgggcagcgcccaccctcgcccctggctgcggctccgaccccagccccagccgcggccagcgctctgggtgctcctgttcttcctactgctgctggctgctgccatgcccaggtcagcacccaatgacattctggacctccgcctccccccggggcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggtttccgagagagcgcttttgcctacgccatcgcagcagctggcgtggtgcacgccgtgtccaatgcgtgtgccctgggcaaactgaaggcctgtggctgtgatgcgtcccggcgaggggacgaggaggccttccgtaggaagctgcaccgcttacaactggatgcactgcagcgtggtaagggcctgagccatggggtcccggaacacccagccctgcccacagccagcccaggcctgcaggactcctgggagtggggcggctgcagccccgacatgggcttcggggagcgcttttctaaggactttctggactcccgggagcctcacagagacatccacgcgagaatgaggcttcacaacaaccgagttgggaggcaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgctgcggccgcggccacaacatcctgcgccagacgcgcagcgagcgctgccactgccgcttccactggtgctgtttcgtggtctgcgaagagtgccgcatcaccgagtgggtcagcgtctgcaagtgagcggcccggggtcccctgggccctgatcgaggtcccctcctggagcctggccctctgaggcttacggtcttggcaaggcagcatcgccttggctcttgggaagaggagattggaccacatgatcttataggaacccctcagctctgaggtctgtgatcgccggacagtccaggcctgtctgaaccccaccactcacttctgtgggctctaggactgactgggttcttcctccctccccgaagcccagacagttcagttgggctgggggttgctccacaccctaaaacaagcctcagccaggcaacccgtcagtctgtctccatcctttcaccccttccctggagatgggaggtggggaatgaatggaagctgacgggcagagagaggaggatt

SEQ ID NO: 39056 - DNA, 2108 bp, Homo sapiens
caaccacccacagcctaattattagcccccatggagcggggaggcgggcgccgtctgctccgggagccctgacccgagtcggagctgtgtgtcgcagccgccccgaccccccgccgatcatgcgccggcgcccctggctctccagtcccactgggctgtgagccccccactcccagcccgtcagggcctgcgcgccatgggcagcgcccaccctcgcccctggctgcggctccgaccccagccccagccgcggccagcgctctgggtgctcctgttcttcctactgctgctggctgctgccatgcccaggtcagcacccaatgacattctggacctccgcctccccccggggcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggtttccgagagagcgcttttgcctacgccatcgcagcagctggcgtggtgcacgccgtgtccaatgcgtgtgccctgggcaaactgaaggcctgtggctgtgatgcgtcccggcgaggggacgaggaggccttccgtaggaagctgcaccgcttacaactggatgcactgcagcgtggtaagggcctgagccatggggtcccggaacacccagccctgcccacagccagcccaggcctgcaggactcctgggagtggggcggctgcagccccgacatgggcttcggggagcgcttttctaaggactttctggactcccgggagcctcacagagacatccacgcgagaatgaggcttcacaacaaccgagttgggaggcaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgctgcggccgcggccacaacatcctgcgccagacgcgcagcgagcgctgccactgccgcttccactggtgctgtttcgtggtctgcgaagagtgccgcatcaccgagtgggtcagcgtctgcaagtgagcggcccggggtcccctgggccctgatcgaggtcccctcctggagcctggccctctgaggcttacggtcttggcaaggcagcatcgccttggctcttgggaagaggagattggaccacatgatcttataggaacccctcagctctgaggtctgtgatcgccggacagtccaggcctgtctgaaccccaccactcacttctgtgggctctaggactgactgggttcttcctccctccccgaagcccagacagttcagttgggctgggggttgctccacaccctaaaacaagcctcagccaggcaacccgtcagtctgtctccatcctttcaccccttccctggagatgggaggtggggaatgaatggaagctgacgggcagagagaggaggattaaaaaaaagaaatagacataactgagctgaagtaattccataaagggcccagacagcctcctccaccattcccttcatcattcatttaacaaatatttattttgcactctctttgcggcactctgggggcggtggggtgcgtgggggtggcaatgcaaggcactgaggccacagatgtgagtaagcgagacacaacacttgtcctcttggaggttacattcttgctggggggaggcatgggcaataaacaagtaaatatacaaac

SEQ ID NO: 39057 - DNA, 2104 bp, Homo sapiens
acagtcacttactctacaggcagtggggcccgacacagacagcgccgcccccgccagccagcctcgcacgccctcggaagcgcaggctcccggcgctgcgctggagggttccccggcaccccagcctcccgtccccagcccgctgcacctccgggccccccttacccttgagaggcaccgggagttgtcgcgggggggcctcgggaaattccccggacccctgtgccaggaggtgcccggttcgcccgctcttcaccccccgccccccccgagggcggtgcccgggggtgctgccccatggagcggggaggcgggcgccgtctgctccgggagccctgacccgagtcggagctgtgtgtcgcagccgccccgaccccccgccgatcatgcgccggcgcccctggctctccagtcccactgggctgtgagccccccactcccagcccgtcagggcctgcgcgccatgggcagcgcccaccctcgcccctggctgcggctccgaccccagccccagccgcggccagcgctctgggtgctcctgttcttcctactgctgctggctgctgccatgcccaggtcagcacccaatgacattctggacctccgcctccccccggggcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggtttccgagagagcgcttttgcctacgccatcgcagcagctggcgtggtgcacgccgtgtccaatgcgtgtgccctgggcaaactgaaggcctgtggctgtgatgcgtcccggcgaggggacgaggaggccttccgtaggaagctgcaccgcttacaactggatgcactgcagcgtggtaagggcctgagccatggggtcccggaacacccagccctgcccacagccagcccaggcctgcaggactcctgggagtggggcggctgcagccccgacatgggcttcggggagcgcttttctaaggactttctggactcccgggagcctcacagagacatccacgcgagaatgaggcttcacaacaaccgagttgggaggcaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgctgcggccgcggccacaacatcctgcgccagacgcgcagcgagcgctgccactgccgcttccactggtgctgtttcgtggtctgcgaagagtgccgcatcaccgagtgggtcagcgtctgcaaggtctcgccctgccgcccaggctggagtgcagtggtgcaatcaaggcttgctgcagcctcgacatccagagctcaagcgattctcccacctcagcctcccgagtagttgggactacaggactacaggcgcatgccaccacgaccgtctttttttttcttttagaggcggagtctcgctttgtattttaagctggtctctgaactcctgggctcaagttatcctcccgcctccaattcccaaagtgttggggttacagagactgagccactgcccctggccagaatacactaaattttttaaaagatcccgtttaaaactaggaattgggggacctggcctcctgacaagagctaatataattatgtcattgtgattttctttttaaaactg

SEQ ID NO: 39058 - DNA, 383 bp, Homo sapiens
tgtataaagaatgctttaagttgtcttctccgactgccccttattcacttaaagacagactcatatgactggggcagtgacttgtagagcttctggtcctttgcaaataccatgctgtcctgtcttaaaagagctgactaaattaaaaaaaaatccacctcaaaaagaagtgaatggctgttatgatcacctcagaagtatctcaggacaaatatacacacacaccccttcatctgacacctgtggcttttaaaaagaaagccagataacggatagccatttaatcagtttgtatccacacaagcacttctccgatttccctcatgcattaggtaatgacactctcccctgagattgatatgtatattataattaataactag

SEQ ID NO: 39059 - DNA, 420 bp, Homo sapiens
aaactgtataactccataaaatattccaggtgacctcaccccttgtaaaaaggatttcaagtcctcctgcctctagtgaagcaagatccatgtgaacacctaatccttgacccagcgaaatgtaaatgaaacctaatgtgtattagttcctagctgaagtttttatgctctctgttcctctgcccaagatgacccaacagtgttcccagaaaaaaaactgccattgattttagctgagaccctcagaggcctgtgtagtgtgaggagaaataaatctttgttgttgtaagccactgatttcggggatcattgttactgtagcataacccagcccatactaactgatattatgtggattctgtcaccatctgtgcagagtaggccattgagatacatcaggcaatgatggattagaatgaa

SEQ ID NO: 39060 - DNA, 2304 bp, Homo sapiens
  misc_feature (1091)..(1091): n is a, c, g, or t
  misc_feature (1624)..(1624): n is a, c, g, or t
  misc_feature (1719)..(1719): n is a, c, g, or t
cggggtgcaagtgccatgcaggtggcttcggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctanggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccnggatggagaattggttgagtagccaaggaaggtcagtgtgaaaagcttgctatggcaaatatagcgaaatctctccactgccttctgtccaccancatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaatcttgtaaagcccagtttcctgtgtgcatgtcatggaccagtgagctggagatggctgaatcttccaagagaaacaaggttggataagcgcttccttttttttagcccaggagaggtggatgtttgtctgagaaaacaatggcctcaagggaggggccttgggcccaccctcacagggggtctctgtgtgatctcttgggatttctccttgtttttgtgagtacctgggaagtgttgtttgttttcttattttctttttaattaaaaaacaaacaaacaagtggt

SEQ ID NO: 39061 - DNA, 360 bp, Homo sapiens
agcctttttaactcctcagctctgtcatcttagcctgaaagcaggcataaacacaaatcaatgcatggctgtgttccagtaaaactttatttgcaaaaacagtccgtggtctggtttcagcctgccggctagggtttgctgaccacagatatagagcatccataggaaaacgttatttaaacattggaaccgttggctgaaatgctctgctgttggaggtttttttgtttttgtttttgtttgagacggagtcttgctctgtcccccaggctggagtgcagtggcgctatctcgactcactgcaacctccgcctcccgggttcacgccattctcctgcctcagcctcccgagtagctggg

SEQ ID NO: 39062 - DNA, 3172 bp, Homo sapiens
  misc_feature (3171)..(3171): n is a, c, g, or t
cacgaggccccacgcctcaggcaactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcaccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagttccccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagccctgccccacctcggagccctgccccacctcggagccctcccccacctcggagccctcccccacctcggagccctcctctccatgaagcctctgctggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccng

SEQ ID NO: 39063 - DNA, 2882 bp, Homo sapiens
  misc_feature (2881)..(2881): n is a, c, g, or t
cacgaggccccacgcctcaggcaactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcaccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagttccccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccaggtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccng

SEQ ID NO: 39064 - DNA, 2911 bp, Homo sapiens
  misc_feature (2910)..(2910): n is a, c, g, or t
cacgaggccccacgcctcaggcaactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcaccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagttccccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccng

SEQ ID NO: 39065 - DNA, 3075 bp, Homo sapiens
  misc_feature (3074)..(3074): n is a, c, g, or t
cacgaggccccacgcctcaggcaactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcaccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagttccccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccng

SEQ ID NO: 39066 - DNA, 218 bp, Homo sapiens
aacaacagcaaaattttattccaaaatcgaatgccaattgatcgtggtgaattaagtgttctagtaataagctgctggctcagaagttaggagcctgtcacattagaatgatccttttcctggtgggaattccatgtttctctttattgagaactcagaacaattgtaaaccccttcaaccaatactctactccttctacctcttcaggatttcaatg

SEQ ID NO: 39067 - DNA, 167 bp, Homo sapiens
gttcccacagtggcctgtgctactgctcccatggcttttgacaattgcattacactgtccatttgcatttgtcatatggccccatctaactaccactagactctaaggcccatgaggacaaatagttgtgtctctccactccccaccccctgttttttgccctagct

SEQ ID NO: 39068 - DNA, 513 bp, Homo sapiens
gggtggtcttctctccagtctacacctttctgaggcactgcaatcggggataccccagttaccacctcttttggtgaccccaaggtttcagctttgcctgagctctccaggctccagctctgggccaaggtgattttggtggagtcatcccagcggggagctaggaggaagaggggattaggaactcccgctcaggcttccttgctgcacgtacacatgtcacatcaaatgatggtgtttcactctggggacatagttgcttttgataaaatgacttttctgcagtttggttaagctgaatgaaacatatttgagctcctatttttgcttcagaggctattgaatagcagtacctgaagatgaaagtgtataagaacagaatcagtccgggcgcgatggctcatgcctgtaattccagcactttgggaggccgaggcgggtggatcacctgaggtcaggagttcaagaccagcctggccaacatggcaaaaccctgtctctactaaaaaaata

SEQ ID NO: 39069 - DNA, 601 bp, Homo sapiens
gcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctttttttctgacccatacttgtctttcatttgaagcaataaacacaaaatggcttagctacttgcagggcagatggtaaatacacagtaaagaaagaagcaga

SEQ ID NO: 39070 - DNA, 356 bp, Homo sapiens
ggaatttggaataaaggaactgtatcatttattctctccttcccacttttttattgctttgaaaaagcagacacttttccttgtcttactgatgtacaaaccttgcttcgttgcaaaatattctgaaaagtcctttcagatctccaaaatcttattacctatttaatgctttaatttgaagtgagatatatatgatgggttttttcatagtgtgaacattagttttatttcgaataactatattttcttgtctatagctatgcataacttgtgattcaaaaaacatcacttaataactttactatttaaaatgtctgtattaaatcattggctagggaaattgggtgctcttttat

SEQ ID NO: 39071 - DNA, 439 bp, Homo sapiens
tctcttgcccaagctggagtacagtggcgcaatctcggctcactgaaacctccacctcctgggttcaagcgatcctcctgcctcagcctcctgagtagttgggattacaggcgcccgccaccacggccggctaatttttgtatttttagtagagacagggtttctccaagttggccagggtggtcttgaactcctggcctcaggtgatctgcctgcctcagcctcccaaagtgctgggattacagacgtgagcgactgcgcccagcctctccaactttaaaataaagaaaatgtcagctggaccacaaacctaaaatattcttaaagcacagacgtccttaaatgaaaacccccttcccactccccagccctgaaaaattacaggtttagcgttacaatacatgaaagcttctaccaaccaggtgcttaggagcaacca

SEQ ID NO: 39072 - DNA, 804 bp, Homo sapiens
ggatagagtcaagacatagatttaactatatgtgcaaacataataaataggtgatgaagcaagcttgctaaagcacaggaaaaggaagcttcacctaaactgctgcttgcaaactgggcagccttttccctctgcaagaacaaccttcaactgtctgccctctagctttataggaagtatcacaagggttctcaaatatcggtatgcgtgagaatctctttgggagtttgtttaaaattccagtcctaggttccctctccagtgatcttagctcagtagagctagggtggggacagagaaactcttagcaagcataccagatcctgaagaggatggtgtgggaatgcactttgagaaatgcctatctaacctttggaaacttaaagtgttcccagtccccattatactttttaaaaccacaatagtcacataaggaaataatctagcagctcatccctttgcatccaatgtttgaactatttttagaaagtgctcttgttctgtcaaagaaccttcaacacagaaaaatacaaaaatgagggaaatgtataattcctgcaagagagaagtgttgttaacatgtcaataaatgttcttagaaagttgtttctatgtctttgaatatatatgtgtgagcctgggcaacatagtgggaccctgtctctaaaaaaattttttttagttaaccgggtgtggtgataccacacctgtagtgccagcaacttgggaggctgaggcaggaggatcacttggatccaggaggttgaggctgcagtgagctatgatcacaccactgcactccag

SEQ ID NO: 39073 - DNA, 422 bp, Homo sapiens
gtgacaggtcagatgcctcctctgtgaagtcctccctcacctcccagcatctgtgctctgactgtgacaactctcacttgaggcctgtcacaaagtatgtgagtggccagggtggagacctcatctgtccggctctatgctccattgctcctgcctggccccatcagtccgacgctcatgtaaccatacatgtactgaagcttaactccatcttatctctgtgatgtgactgccagcgactcaagtgcagggaggttgtccacgtctcctccacgaccacgtgctaaaccccagcaacagtgcctatggaattgtgcagtgcacagcctgtccaccatgatatcaagtttaaccctgggtacaccacagctagcttgcccgcatttgcttaataactgtaatcgtcacagatgctattacct

SEQ ID NO: 39074 - DNA, 512 bp, Homo sapiens
tgaatcctctggttcttggttcggcatgattgtagctgctggtggttgtcatggaaaccagcagaggcgttagatcttagctctgacactcaggagaagctgaacttattctgttatgagctttttttttctctctttttttcttttttttttttttaaatagaaattgtcttgaacctggataaacaggcctcaaagtttttcctccgcctggcttggatatgtttctgtttctgctttctggctacacagaatctaacgacgcatcaagaattggccctggtgctctgtaagatgttttgttgggtctcttttcagttgccagagacagagacctaaatcacgtgtgtatatagacggcagctccatttgttgttccttctagggggtccatacttgtatcagtctgagtccagtccggagagagaaatcacgtagtaatttgaacagagaaaattcaatataaagaattatttactagagcaagggattacagccatgaggggctggct

SEQ ID NO: 39075 - DNA, 416 bp, Homo sapiens
tataaatcactgagtcctaatccaagctgaatgacttgcctaaggtcacaaaatgactcactggctgagctaaaactgaaatactggccttcactgttaattgacttctaactctgcactgttccaacgtggtacacagacaagttgagaagagtgaagttcaggaagaagaagagttctattttcacctcgtgggtaaagtgtttattatttttaaaattccactcttgagctcatgccttctttagatgacaggtgaaatctttccctaacactaggaaaaattggaaaaaaatgggaaacatgaggctttattctgtaccaggccctgtctttcttttggagccatttcaggttataaatatgcattcttcatatgtaatttttttccattggctgtagggttccagtggcct

SEQ ID NO: 39076 - DNA, 407 bp, Homo sapiens
atctataaccaaaaaaaaatcttgagtcagtcttgttagatattgttatacattaagttatttttgtatttctttattggttcattttcttgacgtgtacattttgttcacttattcatgtattcggcaaatgtttagttaacgctcactgtgtcatgcattgttgtaggtgtgtaatacagtaataaataaactctattccctaaggagctatcagtataattatacacatgccgtcacacccacacccacacacatatgtaaaaatatatacacacctacatattatgtattatgtaaatgtagttatagaatactatagtaattcttctttttgatttaaattatatgaattgtaatatttatttaggccttcatattccgatatagagctctccagaaagctc

SEQ ID NO: 39077 - DNA, 418 bp, Homo sapiens
agagtctaaaagatttctactggatcacttgtcaagaagcgccctctctggggagaagggaacgtgaccggattccctcactgttgtatcttgaataaacgctgctgcttcatcctgtgggggccgtggccctgtccctgtgtgggtggggcctcttccatttccctgacttagaaaccacagtccacttagaacagggtttgagaggcttggtcagcactgggtagcgttttgactccattcttggctttcttctttttcttcccagaaggatttttgtgcagaaatgggtcttttgttgccgtgttagtcctccttggaaggcagctcagaaggcccgtgaaatgtcgggggacaggacccccagggagggaatcccaggatacgcactttagggttcgttctccagggagagcga

SEQ ID NO: 39078 - DNA, 563 bp, Homo sapiens
cagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatccctggtccctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaataca

SEQ ID NO: 39079 - DNA, 323 bp, Homo sapiens
ccctccttggctaaaatgagaaatgaccttctcagattaaacaactgactctcttgttgataaacactcataaaatgttaactcttgtcatttcactagacagagttaacataccaacttcctgaaagactgaaatcatactctgctttttcataccaaaatgttaactctatggaccaaatgcaaattatatcaacacttgtgtgtttacagtcgttttaaaacctgaggtaaactgggcacggtggtctacacctgtaatcccaacactttgggaggccaaggtaggaggcttgcttgtagagacccagtctctataaaaa

SEQ ID NO: 39080 - DNA, 630 bp, Homo sapiens
atatatatgtatatgtatatatgtacacacacacacgtccttcattttaagaaaataagaaaaaattcaaaggtggagcttaatcaaattggtatttattgtgattctgtgattaatcataatttatagaaataattcatatctgtaattctaagtatgtgattaacagatataatgaaattaatattatgaattataaaatagatatgatatgaatataatttatattatgaatgtaaaataggtatcatatgaatatgatttacattatgaatgtaaaataggtatcatatgtcccaaattgcaaagctacaactcacaagtttgcatggccatcttagtatacattgctaaatcctcgaatatttggatgattgtgtatagatgtgataagatttgtgtaattccagtgagttcaaccatttactcatcctctcttgcaatatccaactgacaagtatgtgggatcacacttaggcaatttttttctgcttttcctgcatgataccacagttttctctgaataaatgtcttctttttttaggaaaatgcaaatgtattgattacagtttaaaagctaccatttttaaaagcatgtatcaataaatctaacatttaaatcaaaaaaaa

SEQ ID NO: 39081 - DNA, 1395 bp, Homo sapiens
gtataattttcctactgaagcagtaggagcttgaggccatggctcctaaagctttgaaacccatgcagcaactgaaatagagctcagcattcattattcattcactcactcactcaatagttattgagcacctccaacatgcgaagaccgtgctaggtgctggggatttggcagtgaaccagagatgaattctacattgaagccacttagtaaatatttgttaaacagatagacgagtggatggagacatggatgcattagtagtgagtggataatgtctctatctgtggcatcccttctgctctatgttacctcagagaaaaatctcacttctttactctccgtgatcccacaactgttctggatgggggaagtcccaggaagtttagtctcaagtggagagtagggagagaggaaactaaattcagaggggtagtacccacttaaaggcatccatatgatgagtgctggggccagaagagactggaaccaatgagtcatagggtctcagggtcttcagacatcatatggggctgctacagggatcttttcagagcatccccttcaacagatgttcctcagcctccatgctaactctcaatgatggggcacctgagacaggcattccactgcttgcccctggtgatttccctcattctcacctctaagtaacatccaaaataaaaccagcccagccttgggccatgatatcctaacccacagcatgtgcacatgtacccacatctgcatatctgctctacctccagatcaaaatagcaaccagggagattggcagagcctggagtaccaggctgtcttcccagtttgggactggctgaggcactgtgacttcagtgagagtctgggcccatcctcagtctagaaaaagcttatgcaaggatgagggtagcctagagaaagtccagaaaaccacacaaatgaccacctgttgattccaaggcggagacagagcactttctccttttaaaaacagtatcctctcctctcactcaagcttagcctgctcaactgaacagccaggaaaagctgctggtgtttggtgatttgaagggaagggggtctgaacctcagaagcttgtcacttactggggaccctgatgagtttctctctgttgtcctgccttatccctaatctagctccctgatcatttgaatgtaaccctaattggacaagaattttctccctttcagtatggacaaaatcaacaaccatgaatcagagacttttagaggatgggtagtgaagtgggggaagaacagaacattgtagagtgaggggcagagaggcaggcagtgggcatgggtaggttctggttttgtgattagtaatattatctctttaattgaaaaaaataaactcatttcagattcgta

SEQ ID NO: 39082 - DNA, 433 bp, Homo sapiens
tgagaagaaaagaaagatgcaaaatctaactggcaaaggaataaaatcaaatcagacaccaacataaccagcttcttccgccttcccttagatgatagtcctgaagctgctatgctgaacatctgatgggaagtaaaaggcattaacactctgtaaaacatggcaaggaatatattctataacagttcccctgcagatgaaaatttgccctgaggtatagttcctcagagaaaatgagtttttttctctttagtaaattttttaaagcctttttgtttgtttgtttgacagcctgtgctgcagttctaggttctaagcatatacaccttatattcctgttaatggaatttcagactcaatgtttgcctcaccttttgtgtatagttcctcaatggcctatattggatacaaagtcttacacagttttcaccca

SEQ ID NO: 39083 - DNA, 497 bp, Homo sapiens
tcccaacacaaacaaatgtttgaggtgatggatatcctaattaccctgatttgattattacacattttgttcatgtatcaaatatatataccccataaatatgtataatgattatatatcaaaaataaattttaaaagcaattaacattgataaatttgctttatcacatatttgcccatctttctgtccatctgtctgtccgatttactgcattgcatttcaaagtaagttgaagacagcaatacattttacccttaaatattttagccgcatgcttgattctagaattcacattcaaaaattaaactaatatcatttattagacttaaattaattgcaagtaaggtttaaaaggctgagtgtgactacaaagaagtttggaattttctaaggttaaaaaatattctcttgttcagaatattggctgggtgcggcagatcacttgaggtcaggagtttgagactagcttggtgaaactccatctctactaaaaata

SEQ ID NO: 39084 - DNA, 1332 bp, Homo sapiens
gccgggcatggtggcggctgcctgtagtcccagctactctggaggctgaggcaggagaatggcgtgaacccaggaggcagagcttacagtgagccaagatcacgccactgcactccagcctgggtaacagtgcaagactctgtctcaaaataaataaataaataaataaataaataaataaataaataaaagctataaaacaaagaagttttaaacaggcacttcacaaaagagaaaaataaacatgaaaaggtgtttgatcccatttgtaataaaaaagcacaaattaaaaccacaatgagacaccactggacaagcatcagaatggctaaaattaaaagtggccatgaggatgtggagaacctcaaacactggcatgaatgtgaactgctccctctttagaaaagtctggcatttatccagtaaaaatcaaagacactcacacctcgggacacagcagtgatgccttttctaggctatgcaatgccaaaaatgaaagttcattttgagggaaactaatcaaatgagatgaacaaagtctctcactgcatcttaccgcatttttcatttcccttcatttttcaggggctttgaattccttcgaaagttggaagaatgtgcacacctgtatgcaaagtttccagtctttttttcttttttgaagaagacagggtctcactatgttgcccaggcttgccttgaactcctgagttcaagtgatcctccttgctcagccttcccagtagctgggaccacaggcacaaagtttagagggttccctgatgttctgacggctacctctggatcctggtatccagggattcctatattacaggtacagagctactggagctaaagcagtgcactcaaactattcgacaggtcctggcggaactggtaaggaaggttaccccgcttccagaatgaatacatttatccattttatactctcctgcaggtgcagcctagggtcaccctgaacacacgatccatctacagatgccccttatcctcagtgactagcattagaggcctcccaaacagatctgctcagaggcagaattccaaactcaagtatatgtctcagtgtaaattcataaactggcacttggacttattaaaatcaaaaataagtagagaatgattagcaagagctatcaagtccaaagcagttattttgtggctgacaacactgaggacagtgtgagataaatccactgatcaaactgaccagtagatctgagagaccagaacctaggactcctgcttcccaagccaggagcgtctcccttttacctatcagctctccctctggccacccatccactttcc

SEQ ID NO: 39085 - DNA, 616 bp, Homo sapiens
cactgcactccagcctgggtgagacagtgagaccccgtctcaaaaaaaaaagattaatagggatggggtctcaccatgttcctcagactagattccaactcctagtctcaagcaatcctctcaccttggcctcccaaagtactggaattacagggctgatgagccaccatgctcagtccattttttatttctgacctgtaaaactataataaatgtgtgtcgggcagaggcagtggctcatgtctataatcccaacattttgggaggctaaggtgggaggatcacttgaccccaggagtactagaccagccatggcaacatatcaagaccctgtctctcaaaaaaaaatttaaaatttagctgggcatgatggcatgcacttttagtcccagccacttgggaggctgaggtgggaggatctctgagtctgggagcttgaggctgcagtgactatgatcatagaaccgcactccaccctaggtgaaaaagcaagacgtgtctcagaaaaaaatataaataaataaaacaaatgcatgttgttttcagacactgagttggtggtcaattgttacaacagccataggcccctcaagcatcacctacaattgaccctttc

SEQ ID NO: 39086 - DNA, 351 bp, Homo sapiens
taaacgcatcctcattccttaacagcaaccaacaaaggatgaagacatcagctcaacccgcgattagagcagacaagagtactaacgcgatcctgagttgggtttccttgtctaactctactccagaagatgagaagtatggcccatgcgcagccccagcttcacatgtgataccagatgaccatgtactggtcccacaggtcttgcaagtttttcctgttgttccatgtgcccccacaggatctagatccttctacgacacacaggaggcactcaagccagaaggctgggtgttcctccaccttcttcctcagtgctcctaagagttctgcaagcgccacctcccgccac

SEQ ID NO: 39087 - DNA, 1137 bp, Homo sapiens
atccaagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattcttacttatataatccaatgtcagtaaatataagcactaatgaatgctgacttgaatgctcagggttttcttgaaaattctaaattctgtgataaataattgaccactgtgacaacagaatgtaagtcattaaagtgcattccattacagtaagttggcaggagttcaaacagttctctgtaaatttgtttaactgcgtagattaaatggcaatatattttctataatgaaacttgttgaaatgagagggaatcagctatttacaatcatggcataactacctaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctggtaagtagtttgggatgttgtttgt

SEQ ID NO: 39088 - DNA, 667 bp, Homo sapiens
caagaaactttccgcaatgttgttatctgaatatgccaaatattaagtaatattttctggcccttactgatgcatttgtctaaccttagtttatcacttgcttttatgaattataaaatgttatgatactataatctgtttctcaggttatctgtactattttatctacatttcttttatttttctataatgttttaattttattatcttataatatattctaatgtctagcgatagaatacccataatctttcgccaaatattttgagtttatttggggaacacaaattatgaatatggaatatatgttcaacatttagttttattctttctcttattttatctagtttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttagtaagtatctatatcatatgcttttaacacagtactttcaaatactattaccactgtaatgttagttctagccttaaattctaggacttgggataaataaaataagaagtaacatatataattttggaaaatatattttattcagttgg

SEQ ID NO: 39089 - DNA, 382 bp, Homo sapiens
attcgcggccgcgtcgaccgaggttgaaggctcggctgctcaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagagttgacgcggccgtgaatttatattagtagcccgggaattctggaccg

SEQ ID NO: 39090 - DNA, 335 bp, Homo sapiens
tgccgcttcctgtttggactaggagccccgcggtcgcaaattgcgagaatttgggaagggaatctttatcttctcgtctagttctccgaggttgaaggctcggcctgctcagagaaggaaactgaggtccaccgagttggagaaacctactcaacaccagagtttcctgaataagtttttcccaagttctgtgttattctttttgatgaaaggatactggcttccctacaatcatcttttcaacttctaaaatgtttaattttttaaattgaggtaatgctttaaaaatcaataaagctataatacaattctaaatagaacttctctacaatatg

SEQ ID NO: 39091 - DNA, 1201 bp, Homo sapiens
atccaagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattcttacttatataatccaatgtcagtaaatataagcactaatgaatgctgacttgaatgctcagggttttcttgaaaattctaaattctgtgataaataattgaccactgtgacaacagaatgtaagtcattaaagtgcattccattacagtaagttggcaggagttcaaacagttctctgtaaatttgtttaactgcgtagattaaatggcaatatattttctataatgaaacttgttgaaatgagagggaatcagctatttacaatcatggcataactacctaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttagtaagtatctatatcatatgcttttaacacagtactttcaaatactattaccactgtaatgttagttctagccttaaattctaggacttgggataaataaaataagaagtaacatatataattttggaaaatatattttattcagttgg

SEQ ID NO: 39092 - DNA, 1286 bp, Homo sapiens
atccaagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattcttacttatataatccaatgtcagtaaatataagcactaatgaatgctgacttgaatgctcagggttttcttgaaaattctaaattctgtgataaataattgaccactgtgacaacagaatgtaagtcattaaagtgcattccattacagtaagttggcaggagttcaaacagttctctgtaaatttgtttaactgcgtagattaaatggcaatatattttctataatgaaacttgttgaaatgagagggaatcagctatttacaatcatggcataactacctaggcactcagcatctcgatgaaaactgttggaaaagaaaaactttcagagtcattctgccctcagagtagtcaagccaactaaactggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttagtaagtatctatatcatatgcttttaacacagtactttcaaatactattaccactgtaatgttagttctagccttaaattctaggacttgggataaataaaataagaagtaacatatataattttggaaaatatattttattcagttgg

SEQ ID NO: 39093 - DNA, 1040 bp, Homo sapiens
tgccgcttcctgtttggactaggagccccgcggtcgcaaattgcgagaatttgggaagggaatctttatcttctcgtctagttctccgaggttgaaggctcggcctgctcagagaaggaaactgaggtccaccgagttggagaaacctactcaacaccaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttagtaagtatctatatcatatgcttttaacacagtactttcaaatactattaccactgtaatgttagttctagccttaaattctaggacttgggataaataaaataagaagtaacatatataattttggaaaatatattttattcagttgg

SEQ ID NO: 39094 - DNA, 1413 bp, Homo sapiens
atccaagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattcttacttatataatccaatgtcagtaaatataagcactaatgaatgctgacttgaatgctcagggttttcttgaaaattctaaattctgtgataaataattgaccactgtgacaacagaatgtaagtcattaaagtgcattccattacagtaagttggcaggagttcaaacagttctctgtaaatttgtttaactgcgtagattaaatggcaatatattttctataatgaaacttgttgaaatgagagggaatcagctatttacaatcatggcataactacctaggcactcagcatctcgatgaaaactgttggaaaagaaaaactttcagagtcattctgccctcagagtagtcaagccaactaaactgtgagaagtcaatgccttgcctttgtgcatcccattactaatggaggataagaagttattttcttcaaaggctgacttccagaatttttggctgaacactttttgtcaagtgtatattccctttgtaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttagtaagtatctatatcatatgcttttaacacagtactttcaaatactattaccactgtaatgttagttctagccttaaattctaggacttgggataaataaaataagaagtaacatatataattttggaaaatatattttattcagttgg

SEQ ID NO: 39095 - DNA, 389 bp, Homo sapiens
tttttttttttgagacgagtctcgctctgtcgccaggctggagtgcaattgtgcaatctcggctcactgcaacctccacctcccgggtccgagcgattctcctgcctcagcgccccgagtagctggcgccaggccccaggcttccagctcagcttttcccgggacctgtcctagctgttgctttcggccaggctgggcttcacaagagaggtggggtggagttctggcccagggaacagtgaaacggcttcagaaaccaaggtgtggctaatctgatccaggaacatctgccccgcccatgcccattaaccttttttggcaccagggtagctttagcctactcagcctcttctccaccactctaatagaggtaaagtttggggagtaca

SEQ ID NO: 39096 - DNA, 207 bp, Homo sapiens
cttatttttttcacttactactaaagcttattcaactaatttttcctcctattcattcaatgtcagctgagcccatgcaccttctgagaagcattgtttacacttttgcatttcacatttacaacaccataaggcaggtactactatcattccaagtttatagattaaaaaacaaataggttgaggtacttgcctagcaccacatta

SEQ ID NO: 39097 - DNA, 255 bp, Homo sapiens
ccggattcctccacgtgtccccctgtccctgggatggagatgctggtatcactcggcccgtgggcttcagtgcaatgccattcagtaactgtggattgagcacctactgtatgccaggaaccacttggggtggggacctggggataagtctgagagatgctgttattctcttctctgagcttccagacctgtggaagagcatgtagttgtcaaagaatccctcaaataaatacagatgtcccccaatgactaaga

SEQ ID NO: 39098 - DNA, 359 bp, Homo sapiens
acaaaatctcagtttgtattaatgctgcaacttgccctgccaacttcctgagttaaaaatgtaaagcttgccaggtgcggtggctcaagcctgtaatcccagtactttgggaggcagaggcaggtggatcacttgaggtcaggagtttgagaccagcctggctaacatggcgaaaccccatctcttctaaaaatacaaaaattagccaggcttggtggtgcatgcctgtaataccagctacttgggaggctgagacaggagagttgcttgaacccaggaggcggaggttgcagtgagatgagatcatgccactgcactctagcctggccaatagagcaagactaagtctcagaaaaaag

SEQ ID NO: 39099 - DNA, 770 bp, Homo sapiens
gtgggcacaagtttcagattatgctgtggacggaggggatggtggaattgttcactgttgccatgatggtttttcgtacatttttcctccaaagctcctagagttaatttccttggaaaatttacttctgaatatattttataaatctggggagtatcaccatgtgttagaatgagctgagtggtaaattcagttgccaatttgagtacgtatttcagaaagctgctattgacccctaagggggcactgaataatgactgtgcttggagaagagaggttgattagccatcaaatgaatttgactagatgacttgcctgtttacttcatatatgtgaaatacagagaagcatttaatcgtaaatgtttcatttattttatgatcctgagaacattgcagctggatttattgcttttccatacttttattttctttcactcttccctgtttccctcactgctattttcacctactgctgtttaaccttcaattaaaaaaaaaaagctgttctgatacaccatcaggtttgtttgaaaagagcaccttggtgtagaggcttcaaattcaaaccagaaaaacattctgcaggatctgccagggagagctgcctcctgtcaaaacccagcggccttgcagcgttggccagagtcgctctgtccctcttgactctgacttgtctcttcctgcttcagagtcacttgtatcctcatggattagctgccttcactgaggcggcccaaggacagggagagggactctcgcttgttcact

SEQ ID NO: 39100 - DNA, 315 bp, Homo sapiens
gactcaccctaggtgaatgaaattacgtgaaactcacagagaagaaatatatattatggtaaatggggtcttactgaacaaaggtccagggatgaaaataaatcaagagaaatttatcgtgaacagtggtcagcttcttagaagaacatatagattcgtcacaattgcctttggtatttcctgtttccctacacttcttaccaaatgtgctaatacagatggttgtgggctcagcactgattagaaacaagaggtgggaagtcatgaccagagccatcttcaccaacatatattcacagtgactctttaaatatt

SEQ ID NO: 39101 - DNA, 204 bp, Homo sapiens
ggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagc

SEQ ID NO: 39102 - DNA, 433 bp, Homo sapiens
tgaggagtttctctctggttgcccaggctagagtgcaatggtgcaatctcggctcacttggcaaatttcgcctcccaggttcaagtgattctcctgcctcagcctcctgagtagcttacaggcatgcaccaccacgccacgccccactaatttcgtatttttagtagagacagggtttcaccatattggtcaggctggtctcgaactcctgacctcaggtgattcacctgccttggcctcccaaagtgctgggattacaggtgtaagccaccacacctggcccttagcagtaaatttgatgcacctgtggaacatgcaagttgtggtaattgtgcaggtgaatctgaagttcaagaagaggtttgttgaatctgaaaattctgcaggacaagaaatagctgtatgcatatcccacagtcactttctcatgata

SEQ ID NO: 39103 - DNA, 378 bp, Homo sapiens
ctcaatcagacgccaattgcggaataccagctgatattctaccctcaactcatgctaaaagctttctagtctttctcaaggaaacctgtccaaagggatatgtgatcccaggaattattattgtataagtaatacttggatgtttttactaatagttcacacatttcacagccctttggtggagagcctttttcgttaatgttctgttcaagaataattgcatagtatttataatcctctcagggattaagtatagatgtaatacacaactcaaagatgcttgttgatgttcactttgtaaaaattcatcaagttgtatacttgatatttgtgcactttctgtgttacatattttttaattaaatacttatagaaact

SEQ ID NO: 39104 - DNA, 283 bp, Homo sapiens
caggggctacataacatagtggtttacagcaaggatttgggatccagactggccagatttgaactccagcactattccttgatacctctgaaacttgggacaagtaacttagtcactatgtatgaaaagagataataatactagtaccttcctcatactacaagactacaagatgtggtcaagaccagaaatatataagcactgtaaaaacaatgtaaaaccaaatgaaaattcttcatttgtatcttccaaaaataaaaaaatagctatttgggattcttgt

SEQ ID NO: 39105 - DNA, 1095 bp, Homo sapiens
cagataattcatagagactaatttcagtcacttcaacgttggcattgacttatcaaataagcaataactaggcagtgtcagtaacatctgttgactcatcaagagccaaggaaaaccactcagggtcatttgccttgttttttattgactgttgatgttgttcccagtgttctcaattctttaagcaaccattcttgccaaaaggctaatttaatagtcttaagtttactttggacacagtccttcagccgatagaatcaaacacaatttagttatcgttagtaaaatgttttccttgcttggttaacatctgagtcactttggctgcaactttattttcatttttgagtttgtttttttttttttttgagactgagtctcattcttttgcccaggctggagtgcagtggcacaatctcagttcactgcaacctccaccctgcaggttcaagcgagtctcctgcctcagcctcccaagtagctgagattacaggcacatgccaccacacctaactaatttttatgtttttagtagaaatggggttttaccatgttgtccaggctggtcttgaactcctgacctcaagtgatccacccacttcagcctcccaaaatgcttggattacaggcatgaaccactgcatctgacctccctatagtattctttaagaacagctataatgacattgcatattaaacatcatactctgacatctaatctgatttttaaaaattcatatactaatgtgccttaaaaatgtcacttcaagtctacttttctttttttctcttgttttgatgttatgggtaagcactagtaataaaaaatttaaaaatattgtggtatgacaacatatgtggcactcaaaatgctggtaactgcattactgcagtttttagtgtgccaagtagcagtgcaaaatgatgacagcaccacataagtctcctttgcatttgttcaactctgccattctaatgtgaaagcaatcatagacagtacctaaacgaatgagtgtggccatgttccaataaaatttcatgagcactgaaagttgaattttacataattttgatgtgttacaaaatactactgtg

SEQ ID NO: 39106 - DNA, 397 bp, Homo sapiens
gcctcatttttataaagatctctatctactctgtttctcaaacaactcaaaataaaaatcctcttattcttattatgattagttaaactctaaagaaatttttaaaatgaggaatatatgaatacaggtactaatacaggctttatgtttgggtaattacttattgctttaagttgtctcattacgatcttttcccacctcagaacaaagagtcagaggagccttctgataatcatctttcttactaaacatgctgattagccaatgataaagtaaagagctgctcatattttttatcccagaactcatgaaatctatttttggcttcaactgtaggcaaggtagcaatgctatcatgataagaataagataatagaaaataagcattttacattat

SEQ ID NO: 39107 - DNA, 294 bp, Homo sapiens
tagctacaaggacaaagataagcctgggctgataagacccttgctaacaggatgggggctaagctgactaaaaccagctaagtccgacgtgacattggatttgacccacgtcctaccccagacataattatacactcattactctcctaagtcactcacccactagtgccatgacagatccgatcatgcccatatttagtagaaaaatgggtggcactccaattctaagagatctccacctttttcctagaagccctcatcattccatcttttaattagaagagctcattaaat

SEQ ID NO: 39108 - DNA, 500 bp, Homo sapiens
aacagtgaaacatgttagttggctagttctttctcattcagtcttaatacatttctttcagtttggcagcaaaattgttttccttaacttgcatgcccttccctgttaaaaatatggaaatttagaaatatacattccttacagtgtttcaggaaggtatgtcatattattttggcttagttttaaaaatcacattaacctctaagctatatgcttcttgaagaagtgactgacttatcatctgctctataataaagctgtagagtggtaataaacaggtttctcctttttttttatctttctcatacgtgggaaccatactgtattttaatctttaaaataatatatatcctcaatatagttttgcttaaagaaaagatacaaaagattcatatcatacaattgcccagaaccaacttctttatacatctctcttctcaaggtttctactcacaatagctgctagaaatgttcccaatccctcacccaatcccagtgcc

SEQ ID NO: 39109 - DNA, 482 bp, Homo sapiens
gtcccgcagatggcaaaggcaggaggaggtatagggaggaagaaaagtaagtgaaagagcatttgttgtttttgtttgtttgttttttaagacagaaagcaaacacagaaaccaagcacgtgatttgttggtttttttcgtttagttttttcctcttttgcagctgcaaggaattttagccaaattagagaggctttgttacccataatttggaattctcacttggatttgaccaagtcaggtagagttggtcaaatctgatgagagaaagaccagaaaaaacaacaacaacagaagtcaaatgatatgaacacagactgctctaatgggaagaagaaattcagaccagctggttgttaaccttcagccaagacaaaacctcagttcagctacttacctagggatgggtctcaggctgaagactgctctctaccatccttgaagcaggaaaaaaactcgaacttgtcttccctgctgggagc

SEQ ID NO: 39110 - DNA, 1103 bp, Homo sapiens
ggattgacagtcggtaattgggtaactggaggcggcttctccggccgggcggccccgccaccgcgacgccgagcccctgacgtcacccgattcgccagggaatgaactttttaataatccgaggagggaggaaggccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtcgtggacagatgatttgaacagcacttcataaaagaagatgtatgaatgccagtaagaacatgacaagatactcaacatcacttgtctttaaggaactgcaaattaaaggcactatatactcacaaaaaatggctaagttaaaaagactgacataacaagcgttgaagaccatgtggagcaactgtaactttcatacactgtgggaatgcaaactggtatagctactttggaaaacagtatggcag

SEQ ID NO: 39111 - DNA, 989 bp, Homo sapiens
  misc_feature (620)..(620): n is a, c, g, or t
  misc_feature (741)..(741): n is a, c, g, or t
  misc_feature (746)..(746): n is a, c, g, or t
  misc_feature (798)..(798): n is a, c, g, or t
  misc_feature (807)..(807): n is a, c, g, or t
  misc_feature (817)..(818): n is a, c, g, or t
  misc_feature (843)..(843): n is a, c, g, or t
  misc_feature (988)..(988): n is a, c, g, or t
ggattgacagtcggtaattgggtaactggaggcggcttctccggccgggcggccccgccaccgcgacgccgagcccctgacgtcacccgattcgccagggaatgaactttttaataatccgaggagggaggaaggccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtcgggcaaatctgaagatnggaatgccacacggcccagccattccttttccaggcatatgagaagccctcacacatgagcaagaaagagatgtggcaaagacattcatggagccctgtttgttaaaacagagaaaaaganattangaaatacccagctgggcaacatagggagaccctgttctactaaaaataaaantttatactngggaggctanngcaggaggatcacttgagctcagangatcgaagcttgcaatcagctgtgatcgtgtcactgcatgccagctgggtgacagagagtgagaccctgtatcaataaaaaaagaaagaaagaaaagaaacagaaataaacttaggacacagcagacggccccatcctgagggtnc

SEQ ID NO: 39112 - DNA, 1211 bp, Homo sapiens
ggattgacagtcggtaattgggtaactggaggcggcttctccggccgggcggccccgccaccgcgacgccgagcccctgacgtcacccgattcgccagggaatgaactttttaataatccgaggagggaggaaggccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtcgtggacagatgatttgaacagcacttcataaaagaagatgtatgaatgccagtaagaacatgacaagatactcaacatcacttgtctttaaggaactgcaaattaaaggcactatatactcacaaaaaatggctaagttaaaaagactgacataacaagcgttgaagaccatgtggagcaactgtaactttcatacactgtgggaatgcaaactggtatagctactttggaaaacagtatggcag

SEQ ID NO: 39113 - DNA, 1244 bp, Homo sapiens
  misc_feature (875)..(875): n is a, c, g, or t
  misc_feature (996)..(996): n is a, c, g, or t
  misc_feature (1001)..(1001): n is a, c, g, or t
  misc_feature (1053)..(1053): n is a, c, g, or t
  misc_feature (1062)..(1062): n is a, c, g, or t
  misc_feature (1072)..(1073): n is a, c, g, or t
  misc_feature (1098)..(1098): n is a, c, g, or t
  misc_feature (1243)..(1243): n is a, c, g, or t
ggattgacagtcggtaattgggtaactggaggcggcttctccggccgggcggccccgccaccgcgacgccgagcccctgacgtcacccgattcgccagggaatgaactttttaataatccgaggagggaggaaggccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtcgggcaaatctgaagatnggaatgccacacggcccagccattccttttccaggcatatgagaagccctcacacatgagcaagaaagagatgtggcaaagacattcatggagccctgtttgttaaaacagagaaaaaganattangaaatacccagctgggcaacatagggagaccctgttctactaaaaataaaantttatactngggaggctanngcaggaggatcacttgagctcagangatcgaagcttgcaatcagctgtgatcgtgtcactgcatgccagctgggtgacagagagtgagaccctgtatcaataaaaaaagaaagaaagaaaagaaacagaaataaacttaggacacagcagacggccccatcctgagggtnc

SEQ ID NO: 39114 - DNA, 314 bp, Homo sapiens
aatttaaaaaccaaacaacttgagctaagtacatgctatctattagaaacttcaagtacagcaatactgatgaactgaaaggtcaaaagaaaaaggatggtgaaagacagaccatgcaaacacaaatcaaaagaatgctgggttgcctgttttaatttctgacaaaatagacttcagagcaaagaaattaccagggttaaaaagagactttatttatttacttatttagttagttagtttttgagatggagtcttgctctgcactccagcccgggcaacagtgcaaggctccgtctcaaccaaaaaaaaaaaaa

SEQ ID NO: 39115 - DNA, 379 bp, Homo sapiens
gatacaaagttaaacattatactatttgagtatctctcaggcataggttgaaagtgtgcttttaagaaagtcttctaaagttgttggtgctctcagaatttactgctggacctcaactggtcagattgtctgaatatgcagaaaacatttcacttcaatttactctgaaaaagcttgacataatgtcctactattcaatatgagtggatatgctttaatttcttaaatttattttactcccattatgcaaaataccaaaaataaactcttgcatttgtcatatagaaatatctagttaaagtcataagttaaatacaagatttatttaaaagcccatgtaaatatacaaattggagaaaggactaattcttttatagtt

SEQ ID NO: 39116 - DNA, 300 bp, Homo sapiens
acagtggctcacatttaacagggtcttttgtgtgctaaacacaatgccaaagtttatataagtgtcttccaattttcacaatgacgctgaaaacagaagaaatgtggagaatttaaacaccatgcctaaagccatgcaggtgaatagtagtcaacacactgcctgttttacctcacaaaatatctccataacatagctgctgttcctaagttcagaatcataaccttaaatgacttggaaaaccattttaggtaaatgtcctatcagctggaacagtcaaataaaatttaaagagagaca

SEQ ID NO: 39117 - DNA, 411 bp, Homo sapiens
tgagacagagtctcactctgttgcccaggctgcaatacagtggctattcacaggtaccatcccagatgtgctgggattacaggcgtgagccaccgtgcccggcctatatttcttcttttatgtgtttttgttttgttttgttttgttttttccttatagacaaggttgtgttctgttgcccatgctggagtgcagtgggttgataatagttcacagcagcctcaatctcctgggctaaagtggtcttcccacctcggcctctcaagtacctgggattacaggcaccagccactgtaccctgctcctatcttgttatatttcttataataggattaatgcaggcctgctgggggcaaagaaagaaacagtccctaaggagcccttaaagaagaatctccaaattacccataa

SEQ ID NO: 39118 - DNA, 369 bp, Homo sapiens
gttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagta

SEQ ID NO: 39119 - DNA, 405 bp, Homo sapiens
gtgctctgctcctgccttgatgaagcccatgtcctgccttgatgaagcctgtgctacctgcaagtgcccgccctgcccctgtcccaacacccaccgaagagccctgagctcaggctgagcccagccacctcccaaggactttccagtgaggaaatggcaacacgtggaagtgaagtccctgttctcagctctgtcatctgcggggcttctgggtggctcctgccaccgacctcactggcatgctagcctgtggcaggcctaggacctcagcggggaggaggagctgccgcaaggccctatctcagcaggagagggaggcttcctgactgacacaggctagccccatcttggtcctgtcaccctggccccaactattaaagtgccatttcctgtcaaaaaaaaaaa

SEQ ID NO: 39120 - DNA, 409 bp, Homo sapiens
gtgctctgctcctgccttgatgaagcccatgtcctgccttgatgaagcctgtgctacctgcaagtgcccgccctgcccctgtcccaacacccaccgaagagccctgagctcaggctgagcccagccacctcccaaggactttccagtgaggaaatggcaacacgtggaagtgaagtccctgttctcagctctgtcatctgcggggcttctgggtggctcctgccaccgacctcactggcatgctagcctgtggcaggcctaggacctcagcggggaggaggagctgccgcaaggccctatctcagcaggagagggaggcttcctgactgacacaggctagccccatcttggtcctgtcaccctggcactttaatagttgggggtcgacgcggccgccaaatttatcgta

SEQ ID NO: 39121 - DNA, 362 bp, Homo sapiens
tgagtagctaagactcgaggcacataccaccatacctggctaatttttaaatttttttttgtagagacaggctatcactatgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatt

SEQ ID NO: 39122 - DNA, 236 bp, Homo sapiens
gcagtcgagggagtgtccaagaccttacacagaaaatcatgttcagagaggaagcttgttgctcattccttttttgtgcccagctgcctgggttcccttctccaccattttatttggtagtaagctatctagagaacttgctccctacgctgagccaataagcgaaatgtgtgagctttgaaggatacagtttcatttcgaggaatggagaatatctgtgcaaagttggggcagtt

SEQ ID NO: 39123 - DNA, 556 bp, Homo sapiens
agaaacaacagaaattttacttcttacagttctgaaggctgggaagtccagcatcaaggcaccagcagattcaatgtctgataagggcttgcctcaaagatggtaccttaggctgggtgtggtggctcatacctgtaatcccagcactttgggaggccaaggtcgggggatcccttgagcccaggagttcgacaccagcctgggcaacacagggagacctcatcttaaaaaaagatggcaccttattgcagtgtcctcacgtggcaaaagggcactcatctcattcatgacacaagagccctcgtgacttcacttcctaaaggcccaacctcttaataccatcacactgggtatttaggttcccatatatgaattgtggggggatattaacatttagaccatagcacctactcatgaaagaacattaataattaacacctctagtgagtatttgtgagtctaggatttacagaacataaggatattgtacaaattttaaaagccaaaatgagttttagtattactaaacaacaactgttcagcaggaaaaaaaaga

SEQ ID NO: 39124 - DNA, 214 bp, Homo sapiens
ccaggctggtcttgaacttctgacctcgtgatccacccacctcagcctcccaaagggctggaattataggcgtgagccaccgcacccagccaccgtgaacaattttttaacatttcacacaaagaatatgttccaagtccttactgtgtattctcaccctctcccatctctctctctgtctctctcataaacacacacacacacgtacacaatc

SEQ ID NO: 39125 - DNA, 115 bp, Homo sapiens
gaaagggtccgctaaaatgaaaaagtctgggaaagggaggatcacagataaaaatttgttttcgaaaagtccttgcaagacttctgtaggaaaagcctattaaaatcacttttcc

SEQ ID NO: 39126 - DNA, 576 bp, Homo sapiens
acaaatgacagagtccagcatttctctgtgcagaaaatgttaaaagctcaacttagaaaaaacagccttatttggccagtagtaccatcagggtgtgttgccagtctctgtaccaagaggctgcacgaggtgatgtttgttaactttgtgaatgtaccatggcccagaggttcagctgctgagaacagcttcacctttcagtggtgaactaatatagcccaggctctccaggccagtgtagaaaccaaacagcatgtggatttatttctagtggaaaatctaacagtaacatggaatggaatacagttgtcccgaagtatccatgggggattaattccatctggtaccctcctccactgaagataccaaaatccatacatgttcaagtcccttatataaaatggtgtagtatttacatataacctacacacttcctcccagatactttaaatcatgtctagattacttacaaaacctaatgaaatgtaagtgctatgtaaatagttgttgtattgtttagagaataatgacccctcaaaaaagtctgtacatgtctagcacaggcacaaacatctt

SEQ ID NO: 39127 - DNA, 381 bp, Homo sapiens
gtccccagcatcctcccacctcacagatcctgcaattctggtgcattctggactccaaataaccctgtatatatagagagagatagagattgcctctatctatatacattcgtaagcttccccaaaatgatcttggtatcaataaagggagaattcaggtacatttcaccatcagcctcacagcatggcagccattgatttgtcctgtggcttccttaccagggaaccaatctgcctttatgagaaaaagacaaagatataatagaaaggttggtgggtgactgtctgccaaattggtatcagggttcagtgaacttttatgatatgactatggagttcacccagaggagtgaactttactggacatgattcagagatacc

SEQ ID NO: 39128 - DNA, 436 bp, Homo sapiens
taaacctaggcttttaattttggctatccagataaaagaacttagtatttcattgtcagtttaaaaaaaaaaaaaaactccaattaatccttgcacttgttgtgatcttcctctttgattcctcttaagatacagcctaagccttcttcactgttataagtcttcatttgatcctgctcaacttattctcatagatgacctactcattgtgaaaatggaggtcatcagttatgaaacctcttacctttgcccatccccacatcagtatcctctgtaccactccactgtcttcccagaacatttgtaatcctgtttgtctgtgcctatgattccactctctgaatggcacttctcctatccctttatgcagatgtcctcttatcctttaagcttcaactgtgctatcacctattctaaaaaaaaattctatgaaaaa

SEQ ID NO: 39129 - DNA, 481 bp, Homo sapiens
gatagaccaagaattgatgtagtttgaaatggttttaaaattttgcatgccaattgcacatgcacattagagtcatttttgagtttttacttaatctgtttcaagtaactgtggcccaaaataaaataatatagtcctaatttcaatgtgtggacaattttcgtgctacagtacaaattgcagtaatattcttcactgttataagtcttcatttgatcctgctcaacttattctcatagatgacctactcattgtgaaaatggaggtcatcagttatgaaacctcttacctttgcccatccccacatcagtatcctctgtaccactccactgtcttcccagaacatttgtaatcctgtttgtctgtgcctatgattccactctctgaatggcacttctcctatccctttatgcagatgtcctcttatcctttaagcttcaactgtgctatcacctattctaaaaaaaaattctatgaaaaa

SEQ ID NO: 39130 - DNA, 317 bp, Homo sapiens
actacaggcatgacccaccatgcccagccatcctgtgacctttatcagcatgaatgacactgcatgtcattcccctgctcaaaaccttctactagttccagcttcccttggggtaaagtgtgaattcctgagcttggcattcaaggctctacccaacccaggccctgccaacctccccctctcattcattgctctgccagggcttagccaacattgtggagcagctgcctctcggccaggggggcacatggtgctgtgagctccatgagcttctagttttggaaacccacttggtgtggtttacctggagtgttccc

SEQ ID NO: 39131 - DNA, 370 bp, Homo sapiens
cctcaaggagttcagcctctagggaaagagacaggcaagtgaacagagaattacagtgccagggtgtaagagcctacaacagatgcaagcacctaattcctacacatagaactgaggaacatttttttgagactggagactggagttaaggaaggcctgcccacagtgggatgactggatcttaaagaatgtgttgaatggagccaggcaatgaaggtgatgaaacatctacccaggcaggcaatacagcctgtgcaaatgcagggacccacgtgtggtggtggtggtggtgatgcaggagtgtgagtggggtgcaaatggggtgggattgcaagtggcccagtaaggagagaggcagggatcatgggga

SEQ ID NO: 39132 - DNA, 612 bp, Homo sapiens
tgctgaattgcctttggatgtaccacacattaggcttgactcaccaccttcatttgacaataccacctacaccagcctacctcttgattccccatcaggaaaaccttcactcccagctccatcctcattgccccctctacctcctaaggtcctggtctgctccaagcctgtgacatatgccacagtaatcttcccgggagggaacaagggtggagggacctcgtgtgggccagcccagaatccacctaacaatcagactccatccagctaagctgctcatcacactttaaactcatgaggaccatccctaggggttctgtgcatccatccagccagctcatgccctaggatccttaggatatctgagcaaccagggactttaagatctaatccaatgtcctaactttactagggaaagtgacgctcagacatgactgagatgtcttggggaagacctccctgcacccaactcccccactggttcttctaccattacacactgggctaaataaaccctaataatgatgtgcaaactcttaatggctgaatgggaaaggaaactgcccaagtttgactaattgcttggcctgtgaatggaaaagactctggtct

SEQ ID NO: 39133 - DNA, 837 bp, Homo sapiens
ctgttaaattattaatgatatttattaatgtttcatcatgcctatttcgctgttctgggcactttaagattaaacctggtattaagtgcagcatactcaactagatgtagacttcacttcatagaattttaaatctgatggcaactatatgcaatacgcatttatttttgtgtgtgtttgtaggaaaatttgtagatgtaacaagcaaaacaaagatttttctgaatttccaactctaccataacagaatttcaggcattttccaagaaatggcatgatagcagctgggttgcatgttgtacttagaacactgttgatggagtatatctgttgtgagcctggtttctgtgtatgtgtccaattcagtgataggagaagaaagcctgtaattacatttgcataaagtggttggctgctaaagagatgtaattccattattccaaacttttaattcatattttaaaatataaaaactagtatatatatcaaggaatattttaggaaatcttgtagttacctgtaagtgtctaactgtgtattcaatcagtaaccaatatggaaattgcagagtttcttcatcagaagatatgagtttaaattttatatttggcatgcacagcaatatattaaatgctgtgcttaactagaaagtattgtgcagtgtgatggccttttaacctccacaatatacattttatttttattccctagacttgcacatgaagtgcatatgttcatatttacccgtttggagatgggtaagatacaaccagcatagctccatctccatggccatctttgatttcatgcaactttcctttttcctgtccccctccc

SEQ ID NO: 39134 - DNA, 516 bp, Homo sapiens
cctgtttttgccctaacttagggaagggctttggattctccgccattcagaatgagtcactgtgagactgcggagcggattttactcatcccccaggaatggacccttggaaggctccagaatgactagcctcaagtgttctgtctcaggcacggggcattttcccccactccacgtctgcagtcacttcctctctggacacatcctgtttctgggagcaggcggcatgccaagcagattgcagcctctgagcagacgggcggagacatccttcctcttatttctagtacctaatcccatcttccttcccagtcagagatatcgatcagcatctctgcttttcccaggtccctgcacgccagggagggagagtagagaaggaacatgtttctattggcaactccaacttattggaagtgcttagaaacctctgctgatttcttaccagcttctgaagcacaggtaatcaagagaagatctagggcaaggagccatctattcattcactcagtaaat

SEQ ID NO: 39135 - DNA, 318 bp, Homo sapiens
tggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacaggg

SEQ ID NO: 39136 - DNA, 309 bp, Homo sapiens
cctgggcaacctgctcccttgcagtgaacttgactctgtactctgaagggagtgggtaggtgatccaagactgacagtttatattcatctgactaggtaagtgtattgagtccaggtatacacagcagtccccacagagggcacctaaggtctagatttcaggaagacatatgggagcctactagcgttcaagtcaaaaccctactaaatctaaagaaatgatgtagttcagatatgctgggcatctgcctagtctgttaacaggctgatccatttatcctgctccataagagaaaaactcgaaagcaa

SEQ ID NO: 39137 - DNA, 342 bp, Homo sapiens
ccctgcccagaacccaagaatcggaaagctaatgctcaaaggaaggtttcgaggttgtcttattcaatctccccattcctcaaacttgttcacaaatgagaaaacaggcccagcaagttgatatggtgagtatcttaagaggaactattaatagaattaaatctccaggacctccatggtggcctcaggagctcagagctcctttctgcaaccagcctcccgggagcagggcatgcctttgggcacagtggtcctctgcagcctagcccaatgttcctgaatcgaatttctgtgacccacatgggcagtctagctcactcaagttccttgttagggtctggg

SEQ ID NO: 39138 - DNA, 704 bp, Homo sapiens
attttttgcaatggagtcttgctcttgttgcccaggctgagatcgcaccaatgtattccagccggggcgacagagcgaaactccgtctcaaaaaaaaagaaagaaaaagaaactgtgtgtttaagcgttttgatatagggggaaggatggacccgatcctttttgctgaagtctgcagatttcataggccaaggtggaggcctagttgaaaagggggctcagggaagcctggctagagcttggtcaaggaggggatcttcatcagtcgtacgtatgtacatggcacgtggacctgcatagacacgtgtttggtggaggctgtcttatacggattctgcacaactcaagtcccctaatgggaacagacttggggaggtcactcttgaggctttttgtggtattgtggctactgggagacctgaggagggttctggtcactagcagactcatttcattcaccccttggaatctgcccaggacttggacttctgtgtaatagtaacttcacgccccaatgatcctccacgttccttgctgatgctgtgattgctcctccaagttctccacctatgtccatctgagcacttggtatttctactctagtgtcaaaaggtcctgttcccaagtctcctcccaaacatttattccaatttatcatccagatgcccgtcctttgccatccctctctgttccagcaaaggaca

SEQ ID NO: 39139 - DNA, 120 bp, Homo sapiens
tgagcgtggaggagatagtgctctctacgcagggcctctgatcacagagcgtgaagactcccttttaagcccttagaggtgaaacataagaaaagcaaaagggcctgccaagttcatgca

SEQ ID NO: 39140 - DNA, 351 bp, Homo sapiens
agggaaggactcagtcctggcaggaattatcatctgccaactaaaaagcccttgggccttgaataaacatcagtggttgctaggcagtactgaacaggcattgggccatgctgacttcaggtgtgattcagcacatcccaagctgcggtgccacagggagagattcctcctgcttacggaaaaaagagggaagagtgggaagtatactctcttgcagcttgggtgccagctcagccacagtagaatagagcatcaagtagattcctaaggtcctcaattccaggccatagcttctggatggcatctctggatctgcccagggtaggaggaacttgccacaatgaagtaaag

SEQ ID NO: 39141 - DNA, 503 bp, Homo sapiens
tcagcagcttgcttctgccatagaagcttcatgtgccactggtaaaattgtttcagtctctaaatagaccctattctttgcaaacatgagtttatttcccaaatctgaattaatgtatagtgtatctaaattctccttaatatttctctgtctagggctaataggactgcttggctctacctcttggttttcagggcaaggcacatcagattcccgttatgtgctgtctctcttcccctgccaaccaggctggggggcaggggcctataaaatattaaattgaagccagcatgttgtggtttgtggcctgtagatttgtagactgcagtggaaagccaggcctatccctttcagttctggtctggcctggctagaaaatgtcaggatagcactgaggcagaacttgagggtgagagaggactctgtaagcctgataaagagcctcttttgacctgatacagtaatgggctgaaggcagggtgaattgtggatgtgctgagtag

SEQ ID NO: 39142 - DNA, 1206 bp, Homo sapiens
aagtcacagattccttaggtgacttcacagggtagtgatgacctcacaagcttccaaagtttccatggcagcgtgactacacacctgcgtcctagagaagcctccctaccatttctctgtaagataccaatctgtttggttggctgagagagaatgactgaccggatcctctatattgtctctaacatgtcctctgtcccctgggagggcagcgcagagctgcagtgcctgccacttctcctcccacacctgggcactaccatgttctctaccgagggtgtggagaaactcaggtaggctggcatggggagacgtactgcctggttggtggctaccgggtccatggggatgctcctttggccaccccaacaaaggctgaagcagagaagccagcccccaggcgtgctcccaagagacgtcaagctacgatagagtcagataaagacctgggttgctctagccccaaaattcggcgcttggagcatcgtggcaggagactgaccccacagaagcttgctggctgagccatttgggagaaaggacaaatgtttagctgtctaagacagctaatgcctcttctgcggtgacctcccctgcccaccactgcagatagagcctgagtcattctgcctatgccttcctcatccagaagcccccttccatgctaactacccatggccaaggagcctcagaaactgtggtttaaaatgagaggttgctttgaacatcccaaggctgaagacggcctggaagaaaacctgatgttcctctactcatctctccagagtccctttttgggcagaagatagaaatagtctgcactctgctagccgaggagtcaagtgcagagagggagtgcagcatagcccagtaagggcttgatctaccagatgggtctttgctttgagtcactgccagcaactaccagcacaaaccaggagggccaggacttgctgaaactggaagcagcagcccatggctagtcacagcaggagaaagcctcctgcttggcatctcaggaggtagaagaaagagacctggggagacctgccacctacagcaagaacaataaggaggaagttgagcaacatccccctgaagctcacatgttactttatttcctgcccattatggccccagtgaggtccctactgctcaatttaaaaaaaaattaaaaaaattatttttccataacagtatttgact

SEQ ID NO: 39143 - DNA, 486 bp, Homo sapiens
atgtgaggacacgcagaggctcgaatatgctctcaaccctatcagttgcctgctttaattcatcccatggaattgttttgtcttttcgacccctcggctatgttatttgtattgtgatataggggatattcggagtcctctgagacgggacaaggacactggacggtctattgtgccatgcttatatattttctgtatacaatgctttctgtataaaaccagtaatacctgagaaacaacagtaacttgacaaaattactattgatcacttaactttatgtatcacgtaagttaaactttatttatttacatgtgtctccctcattagatgctaagttccttgatattttatacatttgtgaattcctggtaattcacatgaagcttgatgcattgtaagtattctgacctggtgaaataaatatacgaatgggcaaaaaaatatatactaaaatgatcaaataaaggttgtgttcagaaacctct

SEQ ID NO: 39144 - DNA, 763 bp, Homo sapiens
aggtggtgagttacttggctcggagcgggcgaggggacgcgtgggcggagcggggctggccagcctcggcccccatgacccgctgtcctgtgccctttcccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 39145 - DNA, 765 bp, Homo sapiens
tgcagaccacgtggcccgggaggcgccgaggccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccaggaaaaaaaaaacaacaacaacaacaaccaaacacaaaaaaaacgaggggaacaaaacgggggccgcaaaag

SEQ ID NO: 39146 - DNA, 695 bp, Homo sapiens
tgcagaccacgtggcccgggaggcgccgaggccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagg

SEQ ID NO: 39147 - DNA, 833 bp, Homo sapiens
aggtggtgagttacttggctcggagcgggcgaggggacgcgtgggcggagcggggctggccagcctcggcccccatgacccgctgtcctgtgccctttcccagcgatgggcgtgcagccccccaacttctcctgggtgcttccgggccggctggcgggactggcgctgccgcggctccccgcccactaccagttcctgttggacctgggcgtgcggcacctggtgtccctgacggagcgcgggccccctcacagcgacagctgccccggcctcaccctgcaccgcctgcgcatccccgacttctgcccgccggcccccgaccagatcgaccgcttcgtgcagatcgtggacgaggccaacgcacggggagaggctgtgggagtgcactgtgctctgggctttggccgcactggcaccatgctggcctgttacctggtgaaggagcggggcttggctgcaggagatgccattgctgaaatccgacgactacgacccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccaggaaaaaaaaaacaacaacaacaacaaccaaacacaaaaaaaacgaggggaacaaaacgggggccgcaaaag

SEQ ID NO: 39148 - DNA, 143 bp, Homo sapiens
gagtaggggcctggtaaaggggtactaagggccccttatttcgttcgctggtagacactgaagtagcccacccctgcaggcaggtcctgattgaaggggaggcttgtactgctttgttgaataaatgagttttacgaaccagg

SEQ ID NO: 39149 - DNA, 296 bp, Homo sapiens
ccggctccatcgagacctatgagcaggagaaagcagtcttccagttctaccagcgaacgaaataaggggccttagtacccttctaccaggccctcactccccttccccatgttgtcgatggggccagagatgaagggaagtggactaaagtattaaaccctctagctcccattggctgaagacactgaagtagcccacccctgcaggcaggtcctgattgaaggggaggcttgtactgctttgttgaataaatgagttttacgaaccagggcacgttgcatggtactttataaagc

SEQ ID NO: 39150 - DNA, 329 bp, Homo sapiens
gcggccgcctactactactactactgctcgaattcaagcttctaacgatgtacggggaagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39151 - DNA, 1696 bp, Homo sapiens
  misc_feature (19)..(19): n is a, c, g, or t
tgatctagaggatccctanaggctgaatggagagtacaagatgccaactccaccactacccctcctaagagaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtaaggcaccgcagtctggagcttggagaggctcccatgggtgcacagggggagggggtaaaggaggtttgaggtaccttgaacagtatgggggctgattcctctgggatgaaggcccaaaagaagagaaggtggccaacaaattattattattattactgtcccgcatgaaggaagtgctgggatctgctttttcagatgaggaaacaaactcacaagtgcaggttacttgcttgtggtcacacagtcagtaagtgtcaaatcagacccaagaaggaggtgttattcatttcttcatttactcaacaaccattttcttgtcgcctgctttgcgcaggaagcaccccacatgctgggggcacagtcatgaagcacacagacagggtcctgcctccagggagtttataatttaggtggggaaagaacaaggaaagtaaagcatggacagattgtcacagataacgacagtgccacgcacaaagcaaaacagagcgatgagatagagcgagcctgggaggggcagctagggccaacgtgcagaggcacgggtgtggcctgtccaggaacagcaggcaggcgtgctccaccctgactacatattcaaatcacccagagagcttacaaaggaaatatcagtgctgggaccccagcccaggccaatgaggcagtcagctgggcattcgtattttaaaaatatgccttaagtgattatactctgcagtcagagttgaaaatgactgatgtagggctttgcagccatggaaaggagcttggattttaacacagtgaaaagcctcaggagtgtttcaagccagggagcaacatactttgatttgtagacagctgtgtgacctcggacaagtgacttaattattctgtgcttcagtttcctcatctacaaaatggagctaataatcatgaatttcctagag

SEQ ID NO: 39152 - DNA, 455 bp, Homo sapiens
catggaggaggcagggccaggcattgggcctctcccattgggagtggggagggcacagaccagacccttgaccatctgcccggcctggtgaggttgggggttggatgtgggggttggatgaaacaacctgagttgccaccccgtgggcagccacggaagaccatgccccacattcacttctgtcacctgcaaagggaggctaggctgagagacgtttccccgagaggaaagatgggccagagccaccagcgtccccatctgtcttctccagggttctaacctttgcccctcgctcatccccttgagagaagagacacctgggcccaccctctgtggggtctgtggggccattgggcttgttacgccccctggagggtgcctgccgtgtggcgccctctggtgggagctggtggttttcacacgtgagagcctgggtgagacctggtttctttctt

SEQ ID NO: 39153 - DNA, 1618 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39154 - DNA, 1583 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39155 - DNA, 1679 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39156 - DNA, 1455 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39157 - DNA, 1673 bp, Homo sapiens
ataataaaataaaataaataaaactaaataaggtcaggagataccaataccatgtgaaaaatgggaagattagggtatgctgggcccacattcccacagggcaccagcagctgggtgggagctgctgttacccttttggcattcgaggctgctccctgagatcagcgaagcacacagtaggccctcagcaaatctgggcttctcgccctttggtcctcatctctcattccctccttccctgactctctcccctgcgggtggtaggggagggaagagctggagggagaccgcacccctgcactgctcaccagagcctggctctttcccatcccatcttggcagggccctaacccccttgcctcatcgccctgcctgcctggtctctccctcttgcccctgcctctgcctttcggcttctccttggctctattaatgcttctcctcactgcccggtgccttttgttttaacagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39158 - DNA, 1211 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39159 - DNA, 769 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccccgtcccaaagcacagagatccgctagagtca

SEQ ID NO: 39160 - DNA, 912 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccaggtcagactgtccacctggcaccggtcccaggggctgggatgcagggcccagcgtagctgtgtctaagccctgctgggtgggcccaagccaatctcctacccaggtcactctggggacaacctctgcttccctgtcccagtacctgcccgccccttctcctctgtcactctgcccctccttctgtgttactgtctctgtccggaacacctgccttggtctcccagactcctcagctgcccctttctcttcatccctcagtttccatcctggtaaggagggcatattgttctagaaagagcccaggctcaagaaccaaactgaatccagttcaaattcccagctctgccattcatcatctgtggga

SEQ ID NO: 39161 - DNA, 318 bp, Homo sapiens
acgggctcaggaaggcttgcttgggagcaagagggaggtgggtgtgtccggggaggcatttctgagcacaagagcctccctggagttttgccaccatctcctcccattctgtggtgcccgcgataaccaccattctgactctcctcacccctccagcctcccggcgtgtggcctgccaacccggctcccattgtaagtctcttgctttctttttggatcgtcctcattttggcttttctgggctcatggaggaggcagggccaggcattgggcctctcccattgggagtggggagggcacagaccagacccttgacca

SEQ ID NO: 39162 - DNA, 1654 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39163 - DNA, 1750 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39164 - DNA, 729 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacaccgtgcttatctcaatccggggatcctcta

SEQ ID NO: 39165 - DNA, 565 bp, Homo sapiens
ctgcttaccgtgggcgtatattcactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctaggtacgcatgcttacctgggcgtatgcaggaggagaacatcacacgggctctcatcgtggtgcagcagggaatgacaccctccgccaagcagtccctggtcgacatggccccaagtacatcctggagcagtttctgcagcaggagctgctcatcaacatcacggagcacg

SEQ ID NO: 39166 - DNA, 1669 bp, Homo sapiens
tgaatgtgccaacaagcattttcatttctttattttaaggacactgggaaaggagccagtcctctgaagagaacactctggtcaggtggtggaggccagtgggaagccatcaggcctgctttcctctcctcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39167 - DNA, 1700 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattcaaaaaaaaaaacacaaaaaacaaaaaaaaacacaaacaaacaaaaac

SEQ ID NO: 39168 - DNA, 1179 bp, Homo sapiens
cctagagtaaccacctggagctggttttctcctggagcctgccttctccacggtgccgttctcccagcctgtctgtttcccacccaggcccagggggcgcagacaaaaaacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39169 - DNA, 1589 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccaagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 39170 - DNA, 1861 bp, Homo sapiens
cagccaagttgctttggtttctttttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtaaggcaccgcagtctggagcttggagaggctcccatgggtgcacagggggagggggtaaaggaggtttgaggtaccttgaacagtatgggggctgattcctctgggatgaaggcccaaaagaagagaaggtggccaacaaattattattattattactgtcccgcatgaaggaagtgctgggatctgctttttcagatgaggaaacaaactcacaagtgcaggttacttgcttgtggtcacacagtcagtaagtgtcaaatcagacccaagaaggaggtgttattcatttcttcatttactcaacaaccattttcttgtcgcctgctttgcgcaggaagcaccccacatgctgggggcacagtcatgaagcacacagacagggtcctgcctccagggagtttataatttaggtggggaaagaacaaggaaagtaaagcatggacagattgtcacagataacgacagtgccacgcacaaagcaaaacagagcgatgagatagagcgagcctgggaggggcagctagggccaacgtgcagaggcacgggtgtggcctgtccaggaacagcaggcaggcgtgctccaccctgactacatattcaaatcacccagagagcttacaaaggaaatatcagtgctgggaccccagcccaggccaatgaggcagtcagctgggcattcgtattttaaaaatatgccttaagtgattatactctgcagtcagagttgaaaatgactgatgtagggctttgcagccatggaaaggagcttggattttaacacagtgaaaagcctcaggagtgtttcaagccagggagcaacatactttgatttgtagacagctgtgtgacctcggacaagtgacttaattattctgtgcttcagtttcctcatctacaaaatggagctaataatcatgaatttcctagag

SEQ ID NO: 39171 - DNA, 638 bp, Homo sapiens
tggcttcaggaaggctactgatgatggggaggaaatgggactcagaattcggtggataaaggttcaggtgggctgcccaccccaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtaaggcaccgcagtctggagcttggagaggctcccatgggtgcacagggggagggggtaaaggaggtttgaggtaccttgaacagtatgggggctgattcctctgggatgaaggcccaaaagaagagaaggtggccaacaaattattattattattactgtcccgcatgaaggaagtgctgggatctgctttttcagatgaggaaacaaactcacaagtgcaggttacttgcttgtggtcacacagtcagtaagtgtcaaatcagacccaagaaggaggtgttattcatttcttcatttactcaacaaccattttcttgtcgcctgctttgcgcaggaagcaccccacatgctgggggcacagtcatgaagcacacagacagggtcctg

SEQ ID NO: 39172 - DNA, 1514 bp, Homo sapiens
ggccattaccaatcgcgaaaccccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatca

SEQ ID NO: 39173 - DNA, 1900 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctacctaaatggtcaatatttttcggacaaggaagaaaatcatccacaaaaataatactccaaagtacttggtgattggcaggaacaggatgtgtgcc

SEQ ID NO: 39174 - DNA, 1459 bp, Homo sapiens
cctcttgagtccttctgagagggagaaagaaagagaaaatgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatca

SEQ ID NO: 39175 - DNA, 1369 bp, Homo sapiens
ggtcgggcactcagaggatgctctgaccttgaaagggtcctatctggagacgagggagtagaacgtgctgaatgtgtgcggttcagggagcatttggtaaccctgcatttgggagcagtgggcagtaacaggttttggagaggtggacagataaggactgtgatcagcgcccgggtccaagagggcgggtacctggacgtctgggtgcctcaccctctccccgaacccttcccacagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatca

SEQ ID NO: 39176 - DNA, 1032 bp, Homo sapiens
tcacagctgttagcagtaatgcattacaaccctgaagttaatcactatttcctgcttccttaggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatca

SEQ ID NO: 39177 - DNA, 770 bp, Homo sapiens
ttaatgcttaaattatatttccctttaggctgtgatagtttttgaaataaagctagtattttcatgttacattttaggtacctatcatttgtcattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatca

SEQ ID NO: 39178 - DNA, 996 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtgagtttcatatttcaagttttgtttaacctgaaatctattgattggaatgaggatacggatacagtattttaaagaaaacccacaggaataaaatctaaattttctttgcatttgt

SEQ ID NO: 39179 - DNA, 500 bp, Homo sapiens
atgttaagactcattcttagcacatcagaagtgtcttttgaattattttagtgaaacgatgcaggtttaacagtaactatgtacttttttcctactgtcttctccttcgtaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaa

SEQ ID NO: 39180 - DNA, 1529 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatca

SEQ ID NO: 39181 - DNA, 2386 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaagaaaagaaggggggggcggcaacacacatacacgggaggggccagaaagaacgaagaccaacgaacggcgacgggaagagcgaggcccacagaggaggcagtaaaagacagccggaggggcaggccaacaacacacggcacacgggaagacaaaagaaccacagagcagagcaagagagagaccaacaaccagcggggcgaagcaccacgagtagcagcaaacgcagcagagaagaaaccgaagcgacaggaacgcagaaacaacccaggaggggaggagaggctcgagcgaaaccaaagccgaagaaaccggggaagggagagcaaacgaagcgccgggggagggggacgacgagacgaaaacccaaaaagggggcgggagacaaacacagcccgacagaaagaagagaaaaagcaacgaagaaagagaggaaagagaggacgaccgggcagaagacgccgaacacaaagagaagcacacaagagaaacagaagcggaggacgaaaccgagaagagagagacgcaaaacgacaagacaggcaccagacgaaacgaagcagcacgcagaacacaaagacagagaggcagagaggagaaggaaagcaggaacaagagcgacgccagacaggagccagaacaagaagaagacgcagagggaggaaacaaacaagagaagaagaacagcaacaccagaagagcgaagaagcgaagcgccacacagaaggagacgcagcgaagagagcggcagtgagacaaagcg

SEQ ID NO: 39182 - DNA, 1011 bp, Homo sapiens
gtgtttaatcgggaagaagagagaagttgggaggtctctgaggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatca

SEQ ID NO: 39183 - DNA, 395 bp, Homo sapiens
ctatcacttgtggattctttgagtacctataaaggcaattgacctgaggtcaggatactggaattcacttagagtagcccttgaataatccctgcattcacataattagggcttagggttcaccttagccattttcacatgtggggtttcttattcctaaaataaatttttttgccttcaataattgttgtgcacctcaatgtattttgtattttggactttttaaaatgttaccaatccttaataatagttgacacttacatagtactcactgtatggcaggcattgctttaggtaatttatacgtccatattaactgattattcattcatcttcacatacacactataaggcaggtacttcacaaagacaccatgaggtaagtataattgtca

SEQ ID NO: 39184 - DNA, 874 bp, Homo sapiens
aatgcaagttttctttccaggtagaaggacaagaaaaaaatgagccaatgccatagaaacgcaaagggttaaaggttttacttttacttttgttttgggtacgctttctatacttggatcaaatgtatttttctgctcaaaatactttcaaattattgaaagttttcattccaaatcctagatttttaggattgttacccttgagaaactgtttctcacactagagctccccccatagtgctctaaatatagcttagtaaaggcacctactttgctctaagcatacttaaagttaaaacaaaagtatgtatacgaagagtttgatatttttaatagttggagtctgttttgctaattttagtgtgcaagtcagcacaaggggcatagtgagcctgatggaagctttcctcaggtgagtgagtttcacaatcaaaattaggtgcctgtttcttaaaattagattctgctgcaggtttacatactagacttttcagcctgcatgaattagtagggatattctttttttacttgcataattgtaattgatttaaacatgtatgccagaattcacaggcccatactaactgtccttaatttctttcctacagcagtactgctatatgccagtcctgtctgcattcttaagggtgcagttcaacacatcctctctagattatggtgaaaaagtattccaaaggaagtcttatcagagctagtgtcagaaagaatgacactaccaattgggcatgatcttcagcataggaaatgtcttagaattttattattttttcctaaattgtgatgctatactacttgtatagctagttaccacatttctaaagcatagtgtgcctctgtgaatcttgttatatac

SEQ ID NO: 39185 - DNA, 294 bp, Homo sapiens
tcgatcctttcccccattcatagtttatggtcccatttaaaattcatgtaatgccgtaaccttttacaatacttataaataaacacgtacattaagaaaaaacaaaccttatattaaatgagaataaaaccagattaaaaaaagatgaggttgcagtatacctggaaataccaaggaattcacttgcctaaccacagaacacaaaccttttgggggtggaaaaaaactgtggagattgtctactgtagcatcctatttaataattaaggaggttaactttcagtgaaatgactg

SEQ ID NO: 39186 - DNA, 313 bp, Homo sapiens
  misc_feature (261)..(261): n is a, c, g, or t
gcggaagtttagtttttaattctgaattacagattacagttattgactttgcattgccttgtagctcttggctgctctttgtggggttcagggaccagtagaatcaggagcccctgggagcttattaggaatgcagaatttcaggcccctccccagacctactgagaatctgcattttaagaagatgtgactttctgacgagctcagatctctctccagccttccctagggttcatcttgcatctgatactctctctcagnctctctactctagctctcactaagaggcgcaggtcattcatcatcatacgag

SEQ ID NO: 39187 - DNA, 312 bp, Homo sapiens
gctcactgcagcctccatctcctgggttcaagcgattctcctgcctcagcctcctgagtagctgcgactacaggcgcatgccaccacgcctggctaattttttgtatttttattagagacagggtctcaccatgttggccaggctggactcgaactcctagcctcaagtgatccacctgccttggcctccccaaatgctgggattacaggtgtgagccaccacgcctggcctgtgatcatttttgatgctttcctttgatcttccaatttctcttcctgctgctcactgtaagccactcctaggttctgcac

SEQ ID NO: 39188 - DNA, 460 bp, Homo sapiens
cagttggatttatgagcctggagtcaggggagaaattggggctgaagataatccatttggaagtcatcagtgtgaagatggtgcttaaagacatgagactgaggtgaggtcaccaagggagcaggcagatagaaaaagttggaggactgagtcccagggccctccaaattccagcagcccagagatgagaaaggaccagctttaaaggtggattcagagataccagcaaaggagaggagatacagcgtgtgctgataaacctgccctctgaaaataaagaaataaacgcattgatttgtagagttttccagtttccatggtgtaaataactcccactgtggtccatttcaggctaccaacatgacgtcactgaacagggagtcaggagctttgcacatagtcaactcttgcaaactattatgagtttgtcctgctccccactgcctggaaaccaagcaaa

SEQ ID NO: 39189 - DNA, 369 bp, Homo sapiens
aaaaatttattttttaaaccaatttccccaaatacctaaatattattttaataatctttatatgtgaatgtataaatccatgccaaaagttactaacattggtaaaatgcctgagccagttctaccacgtagacagtacttattaaaaatggattggtagaccaaaattcttcattgcataaagaaacgtactgttttcttaagatttgtggcccaacagcaaggttataaaataccaagtttggacatcgtgctcacttcagcagcacatatactaaaaattggaatgatatggggaagataatcatggccctgagcaaggatgacaacacaaattagtgaagtgttccatattttattaaaaaaaaa

SEQ ID NO: 39190 - DNA, 355 bp, Homo sapiens
ttcctccaaattactgcaacacctccccaataaggattgagaactgggctgaggctgacatggctgaaatgacagaagtaggctccagaatgtggattaaaacaaacttcatgtgctgaaggagcacattgtaacccagtgtaaggaagctaagaatcataaaacaatacaggagctgaagacaaaatagccagtatagagaggaacataatcgacctgacagttaaaaaaattcactacgaggacttcacaatacaatcacaagtattaataccagaatagaccaaacaagaaaaaatctcagagcttgaagactgtctttctgaaataagagaggcagacaaaaaatagagaa

SEQ ID NO: 39191 - DNA, 581 bp, Homo sapiens
gtcttatagaaaaccaaatggaaaatgaatataaggaaatgcaaaatacattaaatttctttttacccttgctgcctgttttttctttagttcatcctggacttgtgggccaatacttttttgttatgtttaatactaggagagcaaatacataacaggaactgtgatgaatctggaaagaaaatttatatcattcagtcttcctgaagctgtaagaatctccttaacatctattagatttattttctctttgcatttaaagttttggagaaaatatctttgtcatactgacttggttcttagctatgtaagaggactaaatctaggtgcggagtttgctggtttaaatagaattaaaaatttatttttttctggtgacctggagagtgtttcttaaaattataataatgaatacttttcatgctctgatttatgtataggaattattaagagcttcactctgataaagttatttaccacttggctactcaggggtggagtcatttcacaaaggatctgcagcgaatgaattagaccaggagtaacttcacccttctgcttgtcccagctggagcaggatt

SEQ ID NO: 39192 - DNA, 331 bp, Homo sapiens
cttacaaagtggggctcacactatataaagagctctataacttaatgcattctggacattcttccatatgaatagattacaatctgattcttatcaatgactgcaaaatatttcataatatgaatatattacagtatcttcaagcattcttctattgatgggtatttctattgggtatagctttggtttttttgtttgtttgccttggtttggtttacactgttacaagtattgctatactaaacacagcatgaacttatatacttatgactgatagaattaattcatcaaaattagaagctaaatcaaaggctgctgcttcctatgttat

SEQ ID NO: 39193 - DNA, 419 bp, Homo sapiens
acccactcactgtcccccagttgcccatccacatgggacccacacccacactgagcaagccctggcctatctctcttcgggagaaattttgtgatgacagtttacacaagtgagtactcaagctggaaaaaattaagcgaagttccattacatggaaaacagaattcagaaatcccaaagtgtaaccattttgcttataaaacaagactgatggataaaaattaagaaccgcccagaagatttatctggaagaaaggaagaggttgtctttttctttagagtttattgcttatgacataatcttataaagataaagccataatcctctcattatactatgggtccacggaagctgccatatgtctctgattaggatatacatacaaatatctatgccttgttaaaaaggattctctaga

SEQ ID NO: 39194 - DNA, 471 bp, Homo sapiens
acactgcctcttctgcctctctttgccacttgtaaggactcttgcaattaggcagggtcccatcagataacccaagacaatttcccccatctcaaagtcagctcattagcaaccttaattccgcctgcaaccttaattcccctttgccatgtaacctaacacatccacaggttccagggattagggcatgacatctctagggggccgttactctgcccaccaccctacctcactcccacccccttacccccctgtaaacaataatggcagaagcatttattgagcacttactaggtgcctgccattgtgcccagagcttcttcccagaaggtctctttgacctttgaatgatctcatccattcctcacaaccctatggagagggttttttttagtgttctcattttacgtattcaaagaagtaactccccaaggtcacacagtgagtaagggctggatataggaatttgaa

SEQ ID NO: 39195 - DNA, 393 bp, Homo sapiens
tttgtggggcgagccaaactgctgagcttggaatagcatatgcttggaatctgaatatgaataaggcccaggtgccacactttacacacagatcctttgctaaagaggcactatttgtctaacaggcaaggaccaggctggcagtcaggaaggctgggttttggtgctgatcttgtcaccaactatgcactcttgaacaagtcacttcacttcactatcctaagcctgttttctcatctgaaaaataaaggggttagacttagccttttaaatgacatttttgtatatttctactggctataaaattattacaaatatctatgtctgacggtaagatagtctaaatattcaggaaaactccaagtatagctctcctaaaaatgatatgttgcg

SEQ ID NO: 39196 - DNA, 464 bp, Homo sapiens
tctcggttgacatggagagcagggtttgttgttactgttatatggtggtaagggatctgcatgagagctaagggtgggagcacagggcagtagtggtgttggggcccaggcaggcctttgacttgtccaaggatggcgtgaaaagatgctctgctctgttggtcttccaaaaaccctcctaccctacccagagctccagaaaagtcagccactacctaaggagaagtgtttaatttttttggggggggggtgggggcaggcacagagtctcactctgtcaccgaggctggagtgccgtggcgtgatcttggctcactgcaacctccgcctcctgggttcaagcagttctttgcctcagcctcccgagtagctgggattacaggtgcctgccaccacgcccagctaatttttgtatttttagtagagacggggtttcaccatattggccaggctggtcttgaact

SEQ ID NO: 39197 - DNA, 5063 bp, Homo sapiens
  misc_feature (612)..(612): n is a, c, g, or t
  misc_feature (3544)..(3544): n is a, c, g, or t
ctgggctctgagggcgaaggcttgggggagacctggcttagccacccggctagccgcgtttggcatgggcaggtctgtctctgctccgaggcatattcccactgggcagtgacgggggaagcttgggacccgctatccgctctttccgtcctccaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgacgtgagcatcagcgagtaagagtggggatgggccggtccgacccttgcgttctgcctcccgccccgcctgcctgcggcgacccaggctgccgactgtacttgtgcacagccccgtcctgaggcccccatgtggtcggngcccacgagacacctgcagaggaccgtgtggtcgtaggagcctgcatgcgtgaccgctgcacgtgtacacccacacagaaccctcatcactgggaattcctgtcttcagcgtatcctgtgctggggtcgggaggggctggcttggtcccttggcctttctgaacttcattacctctcctaggggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtgaaggggcttctggagtaagtgtgtgtgtgcctgtgtgtgcacccacgtgtgtgtcgggctccccagcccaggcttggtctgtgtctgtgcctcgacctgtccatccctgtgatgtgcagctgtctgcctgtgagtctgttgggccttggagacaggagccaggtgaatggcctcagccccggccccggttcagctgtcttccaggttctgtcctcacaagggtctgtcttcatccaaggtcgtcacaggggaccaagagctccagcctcaggcagggcaggagctcctactcaattgggaaaaatgctctgaaatgtcagggactcattcagagtcacagagccaagcagtggcaagactgggattgaaaccccggccctgaggtttctttgcacccaccaaccctaccctgctcctgtgtctgcctctgtgtgctccccaccccgtctccacaccaacccctggggtcgaggctgggttggggaatgctctcgctgctccttggggccatgttctgccgcctgccatgtctgcttcctatggttgatgcctcaggggagctggaggctcccacctgagaaggacttgctgaatgccctcctgaccccaacccaccttaccccagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggtgaggcctgactggggaggctgcctggaggtcagaggtcatacctcaggactagggggcctgttatggggtcttggccaaactcttgatccgtacctggggccggggtacaggagacactgtctggacacaaggataaggtgacagctgccaaattcaagctaacgaggcaccaggcagtgactgggagccgcgaccggacagtgaaggagtgggacctcggccgtgcctattgtgagcccgagccccagccccacctctcctccccaccagccaggagccccaggccagggcacaagggacctcacctgctctctgggagtggctctgagattcataggcatttgggggtgaaacctctcaaggccctccaattccctaatggtatcccccagtggtgttttctgtctggtttcttggtgacctcaggctgtgggtaggaaaaagacgtgggtgagccctgtgctgggaagcggaagacctgggttctagtcttgggaggacacngggttctgggcctcagcttctccatatgtcctgtggggtggctcccgacaaccctcctctgaggccctggggtctgctgcttggtccccaggctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcaggtaccagcctcatgcctgctgaccctgtggcctttgctgggacagctgagcctctcttctcctgtaatagaccctcttggagccctccctggaggcccctccagaccaggtcctgctgaggtaccaaacccctcgacaaagaggaagctctggaagctcactgcagagggcagagactagtgatgacctctgttctgaccccagccctgtctgtcctcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39198 - DNA, 4297 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtgaaggggcttctggagtaagtgtgtgtgtgcctgtgtgtgcacccacgtgtgtgtcgggctccccagcccaggcttggtctgtgtctgtgcctcgacctgtccatccctgtgatgtgcagctgtctgcctgtgagtctgttgggccttggagacaggagccaggtgaatggcctcagccccggccccggttcagctgtcttccaggttctgtcctcacaagggtctgtcttcatccaaggtcgtcacaggggaccaagagctccagcctcaggcagggcaggagctcctactcaattgggaaaaatgctctgaaatgtcagggactcattcagagtcacagagccaagcagtggcaagactgggattgaaaccccggccctgaggtttctttgcacccaccaaccctaccctgctcctgtgtctgcctctgtgtgctccccaccccgtctccacaccaacccctggggtcgaggctgggttggggaatgctctcgctgctccttggggccatgttctgccgcctgccatgtctgcttcctatggttgatgcctcaggggagctggaggctcccacctgagaaggacttgctgaatgccctcctgaccccaacccaccttaccccagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39199 - DNA, 2260 bp, Homo sapiens
tctcatagctgctctagagtatccccagcatcattgaactcgacctgtccatccctgtgatgtgcagctgtctgcctgtgagtctgttgggccttggagacaggagccaggtgaatggcctcagccccggccccggttcagctgtcttccaggttctgtcctcacaagggtctgtcttcatccaaggtcgtcacaggggaccaagagctccagcctcaggcagggcaggagctcctactcaattgggaaaaatgctctgaaatgtcagggactcattcagagtcacagagccaagcagtggcaagactgggattgaaaccccggccctgaggtttctttgcacccaccaaccctaccctgctcctgtgtctgcctctgtgtgctccccaccccgtctccacaccaacccctggggtcgaggctgggttggggaatgctctcgctgctccttggggccatgttctgccgcctgccatgtctgcttcctatggttgatgcctcaggggagctggaggctcccacctgagaaggacttgctgaatgccctcctgaccccaacccaccttaccccagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39200 - DNA, 2089 bp, Homo sapiens
  misc_feature (23)..(25): n is a, c, g, or t
  misc_feature (30)..(30): n is a, c, g, or t
  misc_feature (37)..(37): n is a, c, g, or t
  misc_feature (40)..(41): n is a, c, g, or t
agcggaggataggccccgccccnnnagggnggagtcnggnntgccggtatctggaacggaggggggcagcagccgccccctggaggaagggaccgggtctagccccgcctgcgtgcgaggcgccgcgccagggtctcaggatgctttttacccaacaagggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39201 - DNA, 3686 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39202 - DNA, 2026 bp, Homo sapiens
tcgacccacgcgtcggcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39203 - DNA, 1609 bp, Homo sapiens
gattcgtgctggtgctaagggattcgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39204 - DNA, 1264 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgaggtaagttgggaaggggtctgaaaatggggtagagagatgtggtccaagggagccagccagtgacgggtactcttgtgtttgctgaattctccaagcccagtgctgcaagcattgagtgagccctagtgtgtgccaggccctgacctgaagctgagcaggggtcagagtgccctgggcagcccaggatgaagtgggctccaacagcagctggagggagttaggtgtgcaagggcctggcagcccatttcccttccacatggtttagcctgctctgctcactactccatggctcacccctcgcccagccatccccaaggcctagcaccagttgatgctcaatatacatttgcagactacagaagttaggttcatttagcgcattggcagagtgtggacgctccacctgacactaccgccttccctgcccctttgcaacagtgtctcttggcttctctttaaccatgctctcctggtttccctctcatttctgtgattgttgcctctgaacttccttcactggctccttcccctcctccctattcctgtcccttcaaatgtgggtgttcttggggttcactgacccccgttttttctgtttgccaactctcagttctgtctctagccgagccttcttttctgagcttgactctcttgctcaggctgctttttggagatcacatctaaaatcaggctcaccatctcccccagaatttgggccacaccgttttgagagttgactccttgcaggcatcgggctaaacattgtctcagttaatccttcacaactttatggttgtagaggaggaaactgaggcttggagaggtagagccaggatttgagcccttctcacacaaatcaacttctgtgctctccattcattctctcaacatctgttgacagttgctatatccaaagtacggggagtgcaaca

SEQ ID NO: 39205 - DNA, 1317 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgaggtaagttgggaaggggtctgaaaatggggtagagagatgtggtccaagggagccagccagtgacgggtactcttgtgtttgctgaattctccaagcccagtgctgcaagcattgagtgagccctagtgtgtgccaggccctgacctgaagctgagcaggggtcagagtgccctgggcagcccaggatgaagtgggctccaacagcagctggagggagttaggtgtgcaagggcctggcagcccatttcccttccacatggtttagcctgctctgctcactactccatggctcacccctcgcccagccatccccaaggcctagcaccagttgatgctcaatatacatttgcagactacagaagttaggttcatttagcgcattggcagagtgtggacgctccacctgacactaccgccttccctgcccctttgcaacagtgtctcttggcttctctttaaccatgctctcctggtttccctctcatttctgtgattgttgcctctgaacttccttcactggctccttcccctcctccctattcctgtcccttcaaatgtgggtgttcttggggttcactgacccccgttttttctgtttctgtgttaaattactgagggtaatggcctccatgtgcaaccaagttgctgcaaagggacatgatatcaatcattttatggctccataagtattacgtggtgtatatagaccatattttctttatctatagaccatattttctttatccaatccactgctgatgggcacctaggttgattccatgtctttgctattgtaaatagagctataattaacatagtgcatgtgtctttttggtagaaagaattgtttttttttggaaaaaaacccagtaacaggattgctgggtcagatcaaagtttttttttaagttcctttttttttttttttttttgagatggagtctccctctgttgcccaggctggaatgcggtggcgcgatcacgg

SEQ ID NO: 39206 - DNA, 535 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagattcacaggaagttggaaggatagtccagagttcctgcatccccttcccccagcatctcctgctggctacatcttacataactatagtacccacaaccaggaaactgggattggtatgaagtgtgtatatgtcctttgtcattttatcacgtgtagatttgtgtaaccatcaagatatggcactgtttcaccactgcaaagat

SEQ ID NO: 39207 - DNA, 339 bp, Homo sapiens
ttgctgcgtgctctacatagtcccttctccctggtcctctctagcctggtctgtgaaatgactagctgtccctgggacccagtgccagcagttaggggaggtgtagtctccagcccaggcccgcagaacagacccagcgattctgtcttctaacctggggatgtgtcggggggtggggcgggaactgatcttccgctctcaatcccaattcctccattttgtgaggttaagacctcatttcaactgtcccttcccctggtcctcccaggtcgcctggaggccaaccagaccctggagggagctggtggcagcatcaccagtgtggactttgacccctcg

SEQ ID NO: 39208 - DNA, 316 bp, Homo sapiens
ccttgggccggaggctcctttgcctgccttggtgacctgggccgtgggaaactgtgaggcagcccctagcctcattctgtggcccgaagaatgttgcctccggcttagcacctctcacttcctctcccatttctccagggctaccaggttttagcagcaacttacaaccaggctgcccagctctggaaggtgggggaggcacagtccaaggtgaggcctgactggggaggctgcctggaggtcagaggtcatacctcaggactagggggcctgttatggggtcttggccaaactcttgatccgtacctggggccgg

SEQ ID NO: 39209 - DNA, 4417 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagcttgcttttcaggaagggggcgggcaggtgagcagccgactcccttagcgccttcggccccggagggactggaggcctggaggggcctcagcgccgccgtgcccacctgtccgcccccagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtgaaggggcttctggagtaagtgtgtgtgtgcctgtgtgtgcacccacgtgtgtgtcgggctccccagcccaggcttggtctgtgtctgtgcctcgacctgtccatccctgtgatgtgcagctgtctgcctgtgagtctgttgggccttggagacaggagccaggtgaatggcctcagccccggccccggttcagctgtcttccaggttctgtcctcacaagggtctgtcttcatccaaggtcgtcacaggggaccaagagctccagcctcaggcagggcaggagctcctactcaattgggaaaaatgctctgaaatgtcagggactcattcagagtcacagagccaagcagtggcaagactgggattgaaaccccggccctgaggtttctttgcacccaccaaccctaccctgctcctgtgtctgcctctgtgtgctccccaccccgtctccacaccaacccctggggtcgaggctgggttggggaatgctctcgctgctccttggggccatgttctgccgcctgccatgtctgcttcctatggttgatgcctcaggggagctggaggctcccacctgagaaggacttgctgaatgccctcctgaccccaacccaccttaccccagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39210 - DNA, 3478 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtgaaggggcttctggagtaagtgtgtgtgtgcctgtgtgtgcacccacgtgtgtgtcgggctccccagcccaggcttggtctgtgtctgtgcctcgacctgtccatccctgtgatgtgcagctgtctgcctgtgagtctgttgggccttggagacaggagccaggtgaatggcctcagccccggccccggttcagctgtcttccaggttctgtcctcacaagggtctgtcttcatccaaggtcgtcacaggggaccaagagctccagcctcaggcagggcaggagctcctactcaattgggaaaaatgctctgaaatgtcagggactcattcagagtcacagagccaagcagtggcaagactgggattgaaaccccggccctgaggtttctttgcacccaccaaccctaccctgctcctgtgtctgcctctgtgtgctccccaccccgtctccacaccaacccctggggtcgaggctgggttggggaatgctctcgctgctccttggggccatgttctgccgcctgccatgtctgcttcctatggttgatgcctcaggggagctggaggctcccacctgagaaggacttgctgaatgccctcctgaccccaacccaccttaccccagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcaggtgacaggcgcaggctgggggaggacttggggagggctggggacagggctcccaagttcttgttcctttctctggccatggcaggaggagtcttggtggcactttgggcaggcaaggctgtggggctggcactgccagctagtgcctctcggctgggctcagctcccgcaggaagctgtgccactgtcttcatggctcttggtccaatgctggactccgcctggaccttgcaaccaagatggagatgtacctttttccatttagttaccacttttatatcaaa

SEQ ID NO: 39211 - DNA, 3639 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctgcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39212 - DNA, 2026 bp, Homo sapiens
  misc_feature (23)..(25): n is a, c, g, or t
  misc_feature (30)..(30): n is a, c, g, or t
  misc_feature (37)..(37): n is a, c, g, or t
  misc_feature (40)..(41): n is a, c, g, or t
agcggaggataggccccgccccnnnagggnggagtcnggnntgccggtatctggaacggaggggggcagcagccgccccctggaggaagggaccgggtctagccccgcctgcgtgcgaggcgccgcgccagggtctcaggatgctttttacccaacaagggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39213 - DNA, 1940 bp, Homo sapiens
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39214 - DNA, 894 bp, Homo sapiens
ctcaaactacccaggtccagcagtcggggcagagccaggttgcaggcgcagttcctgaagcccccctgaagcctgcccctccctttccccagcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctatctcctcactttttctcccaaagtagaaaaaaatgatatctgaaaaaaaaaaaaaaaaaaaaaaaaaaaaaaaaaaacacaaaacaacaaaaaaaaaaaaacaaaaaaacaaaaaaaaaaaaaaacaacaagagggggggggcggcgcgacaaaaaaattcccccgcggggggcgccccatttcccccccccctttttttagaagaggggggcccccaaaggggggccttataaaaacagcgaacggagcggcggagcgcattaaacaaggagcgcggtggagagcaaaaaacccgtcgctgctgtagagctctttctgaggaggagacaaccccccaccgtcgggggggggcaactaagtggggaacagacacaccgccacaggataaaaacacgcactggcgaggaaacacaacattgtgggagagtcagatgtgcgaaacacacgggctaatatctcgccgacaaaaaatgttcgtgcatcggagtaattttgaaaaaattcaggc

SEQ ID NO: 39215 - DNA, 419 bp, Homo sapiens
atcttgttgcagtaaaaagtaacctgaagtagatgattatctgtctagaccagagaataaaacattttagctttgcatctcaaagtgtcttggtggtctcctaggaaatttggtacttcttaatagagttactttaccttaaaaagaaaatttaaaatcttaagtcagttatcaatattgcatcttcaacatttttgtttcacactctcagtcttttattctgtgtgtgtgcttgatcataactcaggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcaggtaaagacctacttggaagatcc

SEQ ID NO: 39216 - DNA, 1568 bp, Homo sapiens
tgaaatttttaagttctaggttctttgctactaaagagtgttggcaaaaggtagttttttgtcatgtgctttgccatccacaaagaactgttagaataagacccgtttaggatttttgaaagactactagtctgtcttggaataaagagaataagtagatatctgcctagatggaagacttttctctgtttctccttttttatcattcacacaactgtctaatacttcataaagtctaaggaaaaaaataattgtttacctggagatgcagatagtgacaacaggatcttaaaatttacaaaatctcaaaaactgcttagtagatcctttgccttgggggattattgtgtgaattataaaaaagaggtttctttatatttgaatatagagcatttttctcttttataagttcacatatttatgagaacttgagttaagatataaataatttaggcatgtgatttcaagtacattgttagctttagtttcagtaagaatgacaactttatatatttcttttttggaatcaattatgatgtattaaagtataaaagtagttctaagagttgtttaataaagtatgtttaagctgttggcgttgtgttattagaaactgttcattaatgtgatgtccgttctgtttgtagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggttagccaatagttggattctttggattaagataattggttttgagtttgacacagtgttaatatatgaaaagcagcagacctttgtggggatgctgaattattgaatactcaatattctttcactgaagcacgaggaaatattttggaacatcatttggacaaatgtcagttgttcaaatgaagaaaataggattggggtacagaatggtttgggacttttgggtgctctactgtcatatctgtgtttattaggctttattaggttagctttatagggtgatggtttcaaaactcaagtctctttatacaagtgtttccaaaattgacttaatagtttttccctttcaactttttctgtcaaaaggtaccattgtcttaattatctaggtctaaaatcttacctttgtctcattctttcctttttccactatgttcagttagtttccaagttctgtgaattaggctttagataagtctctcatgtccatttcttcccctttctcttcattttaaattctctgtgactgctcttcttgtctgggtcttgaactttaaaccttaaacatgtgctgttgcaaccattccctgcttagcctttctggcctctcctttctatctccagtctgtcctacatattgacaatagctaattttccttagatatcacttactttttttttttttaatttgaaaatccattttcaaatcaccttctcatgcttactagttgtttctgctctggcataatattggcatatatgtggtttggg

SEQ ID NO: 39217 - DNA, 4092 bp, Homo sapiens
atcttgttgcagtaaaaagtaacctgaagtagatgattatctgtctagaccagagaataaaacattttagctttgcatctcaaagtgtcttggtggtctcctaggaaatttggtacttcttaatagagttactttaccttaaaaagaaaatttaaaatcttaagtcagttatcaatattgcatcttcaacatttttgtttcacactctcagtcttttattctgtgtgtgtgcttgatcataactcaggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39218 - DNA, 4021 bp, Homo sapiens
tgaaatttttaagttctaggttctttgctactaaagagtgttggcaaaaggtagttttttgtcatgtgctttgccatccacaaagaactgttagaataagacccgtttaggatttttgaaagactactagtctgtcttggaataaagagaataagtagatatctgcctagatggaagacttttctctgtttctccttttttatcattcacacaactgtctaatacttcataaagtctaaggaaaaaaataattgtttacctggagatgcagatagtgacaacaggatcttaaaatttacaaaatctcaaaaactgcttagtagatcctttgccttgggggattattgtgtgaattataaaaaagaggtttctttatatttgaatatagagcatttttctcttttataagttcacatatttatgagaacttgagttaagatataaataatttaggcatgtgatttcaagtacattgttagctttagtttcagtaagaatgacaactttatatatttcttttttggaatcaattatgatgtattaaagtataaaagtagttctaagagttgtttaataaagtatgtttaagctgttggcgttgtgttattagaaactgttcattaatgtgatgtccgttctgtttgtagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39219 - DNA, 3255 bp, Homo sapiens
tttttttttagagatttttcttctgttaggtaatactttggggttaggttaggtcttgtaaaaatgaacttttgcttttcccacagtctcgtagcctcttatttctatttaaaaggacttactacagtttaacgttgttagtcatttttgcacatattaatacctgtcattgattgctttgggctcacagtgtagatctttgcatctcctgtactgctttgcaatccataaacacttctcaggtaatcaaggtctctctttctcattagttatattaagtggttttggtaaagtgttgaatatcatttctcttgtttcttgatcttttaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39220 - DNA, 2549 bp, Homo sapiens
gcagtaccatacggttcctataggtagccaggtcaatctggataagttcaggctctgaagcagctttatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39221 - DNA, 4052 bp, Homo sapiens
cactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgcatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39222 - DNA, 4174 bp, Homo sapiens
cactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttacaaaaaagaaacatgaatggcagagaaaactgaaaacaacaagtaaaagaaaccaatattcgcgtcgacc

SEQ ID NO: 39223 - DNA, 1302 bp, Homo sapiens
  misc_feature (26)..(26): n is a, c, g, or t
gtgcctgtaccggccccggacagttntgggcatcatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39224 - DNA, 3905 bp, Homo sapiens
cactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39225 - DNA, 1310 bp, Homo sapiens
cactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggtaacaaaaaccaaaaagtccaaatggtacttgtactgagctttaagtatgcacaacacttctgtgtttgtttttgagtcaccacagcagcaagatatgaaataaacattaattttattgtacaaaaaaa

SEQ ID NO: 39226 - DNA, 4105 bp, Homo sapiens
cactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39227 - DNA, 4051 bp, Homo sapiens
cactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaacaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39228 - DNA, 1760 bp, Homo sapiens
actaggaagaaacttggagctgttcaggcgatccagcctccaatcgctgctgctcttgtactcggttggcccgggcggcgctgaactgtcgggagcctaggccatggggcagcctgggccttctgcagtgtgaggcgcggggcctcccgcgtcgctccgctgacaggctgcgggcgggcaggcgggaggcgtagtgtgggtcgcggtggcggccccggccgccggccctggccgcggcatcatgaacatagacgtggagttccacatccggcacaactacccctggaacaagttgccggccaacgtgagacagagtcttggaaattcacagagagaatatgaaaagcaggttgtcctgtacagtatccgcaatcagttacgatatagaaataacttagttaaacacgtcaagaaagatgaacgcagatactatgaggaactgctaaagtacagccgagatcatctcatgctgtaccctaaccatcaatcggatattgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtatttttttttttggatcggggctctttaatctcattttaatttccttggtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtatgatcaagttac

SEQ ID NO: 39229 - DNA, 3633 bp, Homo sapiens
  misc_feature (2902)..(2902): n is a, c, g, or t
cactcttactgccttcttaatgatgggaaatctttcaccaaacttgaaaagtcatgcagtcacaatgtttgaagtaggcaaactctcagatgagtctctggacagctttcttatagaactagaaaaggttcagagcactggtgaaggagaagcacagagatattttgatcatgcacttactctgagaaacacaatactgtttctgcgtcataacaaagatctagttgcgcaaactgcacagccagaccaacccaattatggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcagcatattggaccagctatcccagaagtcagctctgtctggtttaaactgtacatttatcatgtcactggacaaggaccaccatcccttttattgtccaaaggtacaagacttcgaaaactgccagatatatttcagagttatgatcgattgctaataacatcttggggtcatgatcctggagtagttcctacctcaaatgtgctcacgatgttgaatgatgctttaacacattctgcagttttaattcaggggcatggtctgcatgggataggagaaactgtccatgtcccatttccatttgatgaaacagaactacaaggagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggagaacctgatttggcttctggctcagatgtaaatgggagtacagagtcatttgaaatggtcattgaggaagcaactatagattcagcaacaaagcaaacctctggtgccacaacagaagcagattgggttcctctcgagctgtgctttggaattccactgttcagttccgaattaaaccggaaagtttgtaggaaaattgctgcacatggcctttgcagaaaagagagccttcaaaacctcttacattccagtagaaaactctctctgcaagtccttaactttgttcactcattccaggaaggtgcttcaatattggatattcacacagagcccagtttttcaagtttgctttcacagtcatcgtatgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgaaaaanaaaaacaaaaaaaaaaaaaaaaaaaaaaaaaaaaaaaaaaaaaaacaactgggggagggagacaatcgacacgcgacgagacacagagagaacacaagagagggggagagcgggggccacgcgagagaggaagacagagcggacaagcggagtaccaagagaagaaggcggggagagaggaggggggagggtacacacagaaaaaaaaacgaccgaggggaaacacacacgacgctgtaagaaaacacacacagaagagaccatcagagagaacataagacgaggaacaaacacgagagatgatactagaagaaggccagaaagaaaaaatggcccagagaggggagaagagaacaaaagagacaaaggaagaacagacgagacgaaacgagaagacacgaagagggaaagaaagagagagagaagatagaccaagagaacgacagaaaagcaacacacgcccagagagagagcgacagaagcaagcaaacgtacagagggggggagagggggagaaagaaaggcaggaagcaaagaagaagcgaacagaggagagaacggtggaggaagagggaggagagagcggggaaagagcaaacaggagcgaaggagagggaaggaggggaagagaagaacagagaagagaggaaaagaagcggcaacgcgcggacagaagcggaaggaaagagggaggagaggagaaaaggcaggggacaggggagacagggcgg

SEQ ID NO: 39230 - DNA, 487 bp, Homo sapiens
taaaactagtgaaaacaaacaaaaaaagcagatacatgtgcattagagattgtaacttaggcctctttaaataggatttctgattattctatgatactttaagacatttacttatacctaatgttaaatgacgagttaatgggtgcagcacaccaatatggcacatgtatacatatgtaacaaacctgcacattgtgcacatgtaccctaaaacttaaagtataataaaaaaaaatcccccccctcaaaaaaaagacatttactgaatgcctacgatatgccagaaatgggctgtatttacacaatacagaaaaagaaaagacaagcattgcatttaagagcacagagctggctgggtatggtggctctcatggtttataatttctaactgtctacttaaaatgaagtgatatgggagaaatttatctggactcaaaatcaggaagaattttatttttatttaaaattagctttatagacactacat

SEQ ID NO: 39231 - DNA, 422 bp, Homo sapiens
tttctttctctctctctctctctctctctctctgtctgtctttctttccttctttctttcagacagggtccagctctgtcacacccaggctaaagtgcctccctctgccttctgcctcagcctttcaagtagctgggactataggtgcccaccaccatatctggcaaatttttgcattttttgtagcgacagggttttgccatgttgcccaagctggtctcaaactcccgggcttaagcgatctgcctgccttggtctcccaaagtgttgggattacaggtgtgagccactgtgactagcctctcatggtttataatttctaactgtctacttaaaatgaagtgatatgggagaaatttatctggactcaaaatcaggaagaattttatttttatttaaaattagctttatagacactacat

SEQ ID NO: 39232 - DNA, 4864 bp, Homo sapiens
ggatccgaattcgcggccgcgtcgactggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaaaaaaaa

SEQ ID NO: 39233 - DNA, 4813 bp, Homo sapiens
ggatccgaattcgcggccgcgtcgactggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaaaaaaaa

SEQ ID NO: 39234 - DNA, 4809 bp, Homo sapiens
ggatccgaattcgcggccgcgtcgactggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaaaaaaaa

SEQ ID NO: 39235 - DNA, 4305 bp, Homo sapiens
cacgcgggcccgggctggtgctgggctggttgctgctggacatgctgggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaaaaaaaa

SEQ ID NO: 39236 - DNA, 4756 bp, Homo sapiens
ggatccgaattcgcggccgcgtcgactggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccaggccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaaaaaaaa

SEQ ID NO: 39237 - DNA, 4844 bp, Homo sapiens
ggatccgaattcgcggccgcgtcgactggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgggggacctaaacctgaaaggataattcgatgggtgccctagtaaaccaaaaaagcctggaatcc

SEQ ID NO: 39238 - DNA, 4886 bp, Homo sapiens
acactgcgccgcggctgcgcagtacacgggaggcttttaattccattgtggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaggaaaaaaaaaaagcaccctctcttgatctcaactgtaacaaggctgtaattccatcaagcgattctactgacatctagtacagtgttgaagcccaagtggttggctggttccagtattagaactcaagttgaaattatatgattaactgaaatttggggcatgcattatttattatacatggcctacaacggttctgtctgcgctgttacgtattacctacacttctgggtttttttgttcttgttctcagcctctctttaagagttcttgggccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaaacccatacagatttccatatgtaataaaaccccgtgttcttggatagatattaataaggttgtaattccaactggtgacataactcctgtgagggataagaatgtgtctgcttatagtaataacatcagaacctctttgtgaaattgcggcctttaatgtacattttaatgaaagggtgcattagtattgtacaggggtcttgtaaagtcatcaaaacttgctatgaactctaattgccatttgaagctactgattggcagtggctctactctaaaactgctttttagcaattgtatttttttcctgattatattttttaatgtactttgatgtttatgctgatgagttttttatgtacttttggtgatgtttcagtcttatgtactcttctgacgtcagaaaagtaccactggttgtttgcagtcttattgtgtaatcagcctaccgcaggcttccatgtataataaagtaattaatattgtgcaagtgtaaaacacttctgttataaaagcagtgtttggaaaataagaaatattaaaaatggttacaaagtattagttaatttccttttcccactttcctccctttagctttagcagctaaagggtcaccaacttgtcattgcaagattcttagaaaatgtacttaatcttaaatacgctgagtactaaaaagtgtttatttcttatttcagtaagtgcggtaagttctattgagtacagagtacaagctgtaatcaaaggatggagaggacctttaccactgtatctcttaagctgtatgatttttctccagtttgttttatacaggttttgaatttctttaacttttattgtgtgtactgaatactgcatatgtattattctgattgtttgctctagtttactaccaataaaagtcctgttaatcacaaaaaaaa

SEQ ID NO: 39239 - DNA, 3644 bp, Homo sapiens
ggatccgaattcgcggccgcgtcgactggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcgcaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaacctcttggtggcaaggggataaagggtaaatccaaattgggcttaacctctccaggagaagggtgtaattaccgcgctgggaaatcctggtagcggtaatcactggtaggggattattcccaattataccaggataggttgtggatatactttccatcatttaacggtacgggatctcgaaacctttccaattgggctcatatctgggagctggataagacatttccggccattttaacacgataggggcgatccagacgagaccttttccaaagttgggctattctcccaattcgtggggttggatccaaaaaattttctggagaattgtggtggctaaccccaattatctgggtgcgcggctttaccaagtggtcctctggaaatttccaaaagccaatttcaattcccacggcttgggtagaacaaaatattttttgggcaccttggatccaaggccttggaatgtatagtttaattacacgacgggaaaaaaaaaggacccttcttgtgatac

SEQ ID NO: 39240 - DNA, 771 bp, Homo sapiens
  misc_feature (771)..(771): n is a, c, g, or t
ggatccgaattcgcggccgcgtcgactggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacacttgtcaggctcttccccttcn

SEQ ID NO: 39241 - DNA, 594 bp, Homo sapiens
atggcagcggccgccagccccgcgatccttccgcgcctcgcgattcttccgtacctgctattcgactggtccgggacggggcgggccggtgagttcggggatggagcctaagcggggcgggggccaaacctggggggctgtggactgcagcgggtttcagaggagggaagccttctagaaggaccggcgcgatctccccggactgcccccacgctcagttccgattcgctgctctttttcgccaggtccgcttcctgcggctgctgcttgccctgcagagcaggaggggggtcaaagaaggcgaaaaaagaaccgcaggagggtggaggggccaaaaagctgcagagggcgaggtggggaggggatccctggtgcaaccccgcagccccactcgtcctcgggaaggagaaaccagagcccccggaacccgagctggggtcaagacatgggtgacgccagcgtcatatagaatagtcactaagcagacaggagtcagcaaaccctttctagaaaggaaaggctgaaggcactttggtccttgctggccgtgagttctctgtctctgtgtcaagtcccgtccctttgtagagcaac

SEQ ID NO: 39242 - DNA, 919 bp, Homo sapiens
atggcagcggccgccagccccgcgatccttccgcgcctcgcgattcttccgtacctgctattcgactggtccgggacggggcgggccgacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacagcaccacccaccatggccccaggcttagctcaacccaaagccatagccaccaccctcagtccctggagcttcctcatcatcctctgcttcatcctccctggcatctgagaagagtcatttagagtgacaggtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctc

SEQ ID NO: 39243 - DNA, 3556 bp, Homo sapiens
  misc_feature (659)..(659): n is a, c, g, or t
  misc_feature (3069)..(3069): n is a, c, g, or t
ttagaccatgcctgtatggatgcccctctttaaggggataataaatcacattcagattatagtgaggggattcaatgtcataggaaatagtggaaggaagacagtatgtttaatatggaaaagagaaggcctcacacagactctgctgatagtcttcaaataagtaagagagtgcgctttagaaaaacattgtatttgtactataggacctagagtaccccagaaataggaggggtagagagaggctatgggaagatttccattcagcctaataaagaaccttgaaaacagttgcttcccaaagatggaagggattgctttatgaggtttcgtatcatgttgcagggttttaaacttacaagccttccggggctaggtggtaaataaatataacagaggttaagagtgtaagatcatagggagtggtggggattgacaagctggagagcatgtgccctgcctaaagtcattttgattcagtttttaaagttatattgaccagctaaaaactatgtatggatagggccacgactagcttatacagagcttttgtgccagttagaaaaagtatgtttcttccgcaagtcattttatttccttcttttagaaaattgtctgactatttctttttaaaaacaaggcattttattgtcctgganaatgggtgataaaagtacaacattggtggccctacggttggtaggaccctatggatggactggattcatagccctatggtagtagccctatggatggactggattcagccctctggagcccaggttacaacctttctgactgtaaacctgtttctggatgtaaagctgatgaaattaggagagaaaagtatttgtctaacattttcagagagcaaaatcatagtgttcaggctaggaaggccctaggaacatgggaggcacagcgtctaccctcagggagatttggggctggaggaggaagcaggtaagttagcagggcattgtggcactcgaggtatcaagagagaatccatctgtggtgtgtgtattcagggcagacagcaggtcagttctacctaaagagtagggggacagatttaatagaggaggtgaggcttggagagaaaaccttgagtgtaacaaccttcacatcatagcatcctttctcctgggaagtgagcctttcagtagaggagggccctttgggctgagctcagaagcacatacattccattttgcctagccttttgtagcatcagtttttcatgctggagagctggaaacgaggaaaggcagactatttgttttaaagcccttcttccaagtcatattgaatgttcttaggcctcccacatggtagattgaggctgactcaggcctgtaggctgggcagagatcactggcacagcctatacaccagcctttagctgccctcacctaagcctcttgacttggtcccttaatccttaattaatctggaatccacaggttacacagggatatgtttcctagatactgtgactctcaagccccttctcctttcccactactgctgcttgtgtccccagatgcctggacttctccaacagcctttctctttagagacctccacaatctgctgaatacacagctgtgtttaggtcacttttgcattcaaaacccctcaatagctccctactgcctttcccatcaaaggaagacagattcctcagcctgacattcagaatcttcttaacatcttccctacccttctttctaaaacatctgttcatcttcaactctggtgagcactttgctctagcaagtggttcctcagtctgcatctttgcagagattttctctacgggaagaaagaccttggatagggcaaggtagaaaacctgctttttctcctagctcaaaaaccaactccatgtgtgactagtcaaaccatttaacctctctgggctcagtttcctcatctgaaaaaaacaggacgttggacaagagcagggatctgggacctatttgttgagtacagttatatgcactctttctcatcagtatggcttatttattatgggtgcagtacaggtgcactgagctctttgtaagcattttctcatttcacataggtggtagtcagccttcaagatggttccaatgatccttgcctcctggtattcacctttgtgaatcccctctcacattaaatcagaactaacctgccatccatagaaacggatgtggtatgtgattttcgaggcgagatcataaaaggcattgtcaacttcctccttggccccttcaattgccccttctgaggaaagccagacaccatgctgtgaggacactgaagcagcaatgtggagactgctatggagagaagacctcccaccaacagctaccaccaacttgccagtcctttgttaacagccagcttggaagcaaatcttccggccccagttaggccttcatgtgactgcagcctcaccaaagacccagaactagttgaactgccccccaaatttctgatccaaagaaactatgagataataaatgatcattgttgttgtaagcccctaagtctttgagtaatttgcttcacagcaatagataactaataccatgggtatttgtattatctctgacagatgaggaaaatgaggctcagagcaactgaatagcccatctgaggttgtgaactggtgagtgatgggaaagggatgcaaatccaggtctgcctgacttctcacccatcacgttatacgcctcatgctgcagtgaccctctgtcaggttcagaggagattgctgaactagaagattgaattgagattggagtcttcctggaataaataaaagaacagccactaaagggtaatgtgatacacttattattctgccaggctcctctgcatactattctaacaaactccttgggtgaataagaaaccaaagctagtctttataacactgggactcacagatgggggatgggaaaagtgctgtgctcatggaaaaaatatttcatttgttaactcggctttaaattgtattacagttgaaaacgggagaagcacttgtggttaatttaacagatccattagtgnaaggacccttagaaatctgtcaaaactttttattatataaatagggaaatttctcagatgggaaaaataacttgctcgaactcaaatcgtaagagccaaatgtcacttgttcatcactttgtggccaaacaactctatgcaggttgttcggaatcataattattatccttggactgtttgttaatggttgttactgattattaatggtctgtggtgtttaccttccaagggtctaacatttttacatgtaaaagaaccttgtagcgtaggaagaagaaggtttcgatggtaaaatcaaccctaaggccacctagtaaactcaatgagcaggggctcttaacctgaagtccttagaagggctttaatctgctgggtgcggtggctcatgcctgtaatcccagcactttgggaggccgaggaaggtggatcacctgaggtcaggagtttgagacaagcctggccaatgtggtgcaaccccttctctact

SEQ ID NO: 39244 - DNA, 1703 bp, Homo sapiens
ggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 39245 - DNA, 1798 bp, Homo sapiens
ggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 39246 - DNA, 1023 bp, Homo sapiens
cccatttttgttatgtaggtcttcctgtgctttcagaaagttgctgctgaaatccttgggatcaaattaaacaaagcagaaatagaacagtcacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 39247 - DNA, 1526 bp, Homo sapiens
tcataaccaatagtgagccatttggaaatagggattttggaggaaaggtttagaagttggaaaagatttaaaaatgggttgctcagaatatttctgctttatatgtgaatcctctttaacatttaaatgtcttcttccaaactcacaaactgctgtaaacattcaatgaaaagttttcgctaaatataatggcttatggaaatattaatcaataatgctattttttactttgaaatgatgagttcttttctatgatttaaaatatatgtgaatgatttatttattttgctctaaattattatcagggtttaatttttcattattgatttgtcagtttttcattagacttatgataacctcaagttaatgtcataaaaccagggacaactcagtagctgagttgccattctcttcttgaaaaaaaaaaatccactctttgtttgtttgtctggcttattcttttaatatcaactcctgcttcatttatggtgtccatcatcagaagttcagcaaagttcagaaaataaaaatatactttaaggagctctttctaaatgttctgatatcctgataatacccctgttttctttttatgacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 39248 - DNA, 868 bp, Homo sapiens
gtaactcttttgtgacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaatattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 39249 - DNA, 1646 bp, Homo sapiens
ggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagatgaggaaaatgaggctcagagcaactgaatagcccatctgaggttgtgaactggtgagtgatgggaaagggatgcaaatccaggtctgcctgacttctcacccatcacgttatacgcctcatgctgcagtgaccctctgtcaggttcagagaagttcagggatgagcatctgagggctggtggctcatcaggaaccaagactctttttttctgctctgatgtcccaagcacaaaggcttcatcctcattcaaatggcttccagattgcgaggtggctgccatccactccatgtctgcatgccatggagcaacaagggaggaggaaaaggatgaaagggagcctaaggaggaatgaatagcaatgccctgaattccaactgaccttctacagaaaagtacctgactgccaagtggtctttccagtcattggtggaggatcactttggtacccctaccaataggctcaccatggtcagcacacacagtgaaggaacctccagcagaagactctcaggcatgccatcatcattgggctttgtgatcacaaccactttctctgctaccagcctgaaggaatgtacctcaatggaaaagaaaatgaagatgctcattaattttcaaggactttaggtgtggagtggatgggtgagtgtagcatggtacttagcacttggttagtcttcttgccctgtttcttgctgggctcttatgatggtgtctgaaaagagaaagatacaacaattaaaaataaagtaaaattacttgttgctgaaa

SEQ ID NO: 39250 - DNA, 1128 bp, Homo sapiens
ggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagatttattgagcacctgtcagttactatttcagtgctggccataagtggagaacaagagagacatgatggctacttcctctgtggatcctcattctgggtgagactcaatttcatgaacgtgtatatttatctgctcctagaactgtttgtaaagtctcattaactgtaaaaccacttcttgatatcttgcctgactttcaggtgcttcagcaacatcgaaacaagtttgagaaccgctcaacttgaccctgagattttgtatgagatgaggtgtgtaaaactcactcgtcaacatgcatcttgtgattgtgttataaaagcagccaaaaggtcaataaacagcaaaattttt

SEQ ID NO: 39251 - DNA, 761 bp, Homo sapiens
  misc_feature (22)..(22): n is a, c, g, or t
  misc_feature (110)..(110): n is a, c, g, or t
  misc_feature (112)..(112): n is a, c, g, or t
  misc_feature (114)..(115): n is a, c, g, or t
  misc_feature (118)..(118): n is a, c, g, or t
  misc_feature (134)..(134): n is a, c, g, or t
  misc_feature (151)..(151): n is a, c, g, or t
  misc_feature (174)..(174): n is a, c, g, or t
  misc_feature (187)..(187): n is a, c, g, or t
  misc_feature (219)..(220): n is a, c, g, or t
  misc_feature (223)..(223): n is a, c, g, or t
  misc_feature (235)..(235): n is a, c, g, or t
  misc_feature (284)..(285): n is a, c, g, or t
  misc_feature (305)..(305): n is a, c, g, or t
  misc_feature (309)..(309): n is a, c, g, or t
ctcctcgaatacctcctgccgncgcggagacaccggggcgggggtcctgccgcaactacctcccttcctcctctcccccgacccggagccttcatacttacccattgccncncnncancatcgaggaggcgggnctggtatcccgggacancatgatcaggagatctgaggagngagagcacaggancggcaactgaaaatcgtcgtgctgggggacgnncgnctccgggaaganctccttaactacgtgttttgctcaagaaacttttgggaaacagtacaanncaaactataggactggattncttnttgagaaggataacattgccaggaaacttgaatgttacccttcaaatttgggatataggagggcagacaataggaggcaaaatgttggataaatatatctatggagcacagaaaagtaaattaaagcatgaagaagagaaatgatgacaagaggttgcacagaaagttactgcataatagatctggaagccaaagtccttaatgcacatctagagatcacggcactaccctgtaccctggaaaatcttcaacatgggccaaaaagatggcacataatcttcctccacctctctccctccacacctactggtttgaagaaacatttgagctgagaggagaggcaatctgtggctaggtagaaaggcaatgaggtagaatttggacaattaattgctagggtgctactcgggctgaaagttgtttggactgagaatagaagaccaatgcatggg

SEQ ID NO: 39252 - DNA, 1573 bp, Homo sapiens
ggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagttgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 39253 - DNA, 1152 bp, Homo sapiens
ggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagatgaggaaaatgaggctcagagcaactgaatagcccatctgaggttgtgaactggtgagtgatgggaaagggatgcaaatccaggtctgcctgacttctcacccatcacgttatacgcctcatgctgcagtgaccctctgtcaggttcagagtaagtgcttattacacagtttcaagtgaacgaacaaactgttttcatgactgaatatataaatctgttacacaagtatatatttagaaaaggagcccataaaaataaagaatgaatattttcaatctca

SEQ ID NO: 39254 - DNA, 849 bp, Homo sapiens
ggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtggaaattctt

SEQ ID NO: 39255 - DNA, 347 bp, Homo sapiens
tccgactccctaagccagtgcattaaagagaaggctgctaatcagctaaatagaaagtggaatctgttcacatgaagtctctctttccttccatcaccagagggacaccaccgtgttctgaaatacactcttgacatcgtttggcaggaaaccctattttgctgaacatgattcatcccttaggttactgtttttaatattagaaagtgagctttcaagtgccaaacaaattttgcagcaggggacaaaagatattccaagtggtctccctggaccttctaccaactgcggccaccaaatggcttaaaagaaaaccttcccgtggtgcttcagaaatgaagcagaga

SEQ ID NO: 39256 - DNA, 381 bp, Homo sapiens
tgcaccatcacccccggcctcatttttgtatttttagtagcgatggggtttccacccatgttggcccaggctggtcctcaaactccctgatcctccgcccagcctcggcccttcccaaagtgcctgagattacaggcatgagcccacggtgccctgaccctaaaagcattttaatgcccacagagaaagccagctaaagggaggaggagcagtagatggattctgtcttctaagtgggatttgagaattgactggattttaaataattaataaaggtgttttacttaatgaacacagtttaagagaactgagttgattttacttcattttacctaaagtacaaaggtaagtgtgtttactcaaataatatgtgagcctttt

SEQ ID NO: 39257 - DNA, 1493 bp, Homo sapiens
ctagaagataaaagccctgcccgagattccccattaattagaaaaactcacttttattcccaagaatcctgaattgccacaaataaggcacttctcataatctgacatttatatcgtccattaataccattcctaccaccatataataatccagaggacccacttctagttaaaacccatttcaaattctctaccttatatctatcacgaaatgccacttactggtctctcagtatgttcttctacctctttaaccatattccctaagctagaaatgccccacatggttagtctcatttgttcttctcaaatatcccagagccaaaaaggaccatcatcatcttcatttcacaaatgaaaaacaaagtcagtcagtctaaggttacctggtctcctaaattcaagtttatctttcttcacatatgtcatgtatttccaagctttttttctctttggataactgggaactttctgttaagttagctttaaaaaaaaataagcataaataaaaaagatataaaatcgaagtttttcttttaatctcaataagtctaaagtccagaataagtggagaactggggcaagaggacaacaaaagaagtcttgttccagcctgggcatcatggcgaacctgtctctactaaaaacacaaaaaattagccgagtgtggtggcacgcacctgtagtccgaactactgaggaggctgagaatcacctgagcccaagaagctgaggctgcagtaagctgagattgcgtcactacacgccagcctgggcgacaggaatgagatcctgtctcaaacaaacaaacaaacaaacaaaaaagtcttgttgagaacaagaagagataaaccaaaggcccattgcttagggaagatgcaatatcaagagacaacagggccaattccctatgcttcatcttcatcaagaagcatgatcttcaagctagggaggtcagaaatctgataaaaggaaaccagcttctaaggtaagtggcatgggtaggggacagtaacagaatacagagctagttcaaaagaatatgctttctgatccaaataactcacactccatgatgctgaaaaaacttttacatctgccttaaaaactaccacaaattatctaagctaccttgacaaggtgccagaagaccagaaatcaaataaatagaaataaacacatgctcaaatttcaaaaaaggagaaatgcaggccgggcgcagtggctcatgcctgtaatcctagcactttggaaggccgaggtaggcggattgcctgagctcaggagttcgagaccagaatgggcaacacagtgaaaccccatatctactaaaatacaaacaattagccgggcgtggtggtgtgcgcctgtagtcccagctactcgggaggcttgaggcaggagaactggttgaacctggaaggcagaggttacagtgagccgagatcatgccactgcactccagcctgggcgacagagcaagactccatctc

SEQ ID NO: 39258 - DNA, 343 bp, Homo sapiens
attttaacaaataccaacagaacttcttgtggtaggccagctttccaagttactggttcaagagaacagtcattttataacaggtataaaatcaaagacgtttagtaaaatattttgcccttaattctccatggatagcttgtttatgaagagttcagtattcagggaagatggaaaaacagcccagtgtcagctaaagtaataaaaccgacttaatcccaaattgacaatttaaagccctttaaaattacttgttgcaaacaagaaataatccacccagtctgtcatctcttttcagcttattagtagtggaatctcttaggtggctctttaaaccgtgtgt

SEQ ID NO: 39259 - DNA, 419 bp, Homo sapiens
tttatgttatctccaaatgaattactaagacaaagggataataaatgggaagtgtacaacccggagacttcagaccagaaaatcaaagagagatgatgggaaagggtggagtaatgctgagttttgaagaatgggcacatttagacagaccaaagactgagcatcatatcattgctgccgttccatgaactgagagcaaactgttagatcatgacctgctacagaatcactaggcatcaggaagaagagtaggtatatggtctgtattagagtatagcaatggattattcttccagctgccaagaagtcaagaaggaaagcctgtatttgactttatcatttctattgaatgtctgagtgatacatagagtagtaattttagacatttaagtaactaaagatttatatagctttagtat

SEQ ID NO: 39260 - DNA, 827 bp, Homo sapiens
cagaccctcttgatacttgacaggaaataaggaggggtttgttttattttgattcgtttaaatatgagacttgattacaggttgaggttgaagatgcagtagtggggaagatgagtttgaaaataattgatatggaaaacaatctctaaagcaagatcaatgaggaactgagggatgagcataattgcaagaaattagccttgcacatgaagaaggatagaagataaaggatgcatgtgggtgtaggcaattttttaggtagaagaatgtgaaaaagatgtttcatgcttttcatataattttctattgagagtagcagattatgttatcagatgaattaagggtgagagggtagagacctggatcagcatggagaaagtgaaattagctgcagggaggaatgagagagagggcaattaagaatagctaaataagttgattaaaggccttagagataggaaacagttaacttgttattccattatacagaattgagtgatttttttcccctaccaccaatgctcaattacctgtgtgtaaattgaataagacagacaattggactgatcctgtttagagtttacaggacatgtgcaaatgaagaggcaacaggtgacaagggttttgaggccactagcaataatgtaattaaagtgtgggcttttgggcttaggctgaagtgggttgggaaggcaagtgagaccaggatgactgatcttaaataagaatttttaaagctggctgggcatggtggatcatacctctaatcccagcactttgggaggcccaggcaggcagatcactggagcccaggagtttgaaaccag

SEQ ID NO: 39261 - DNA, 405 bp, Homo sapiens
tcccaagtaagttgtttagtatgttcaggaattaactggctctgggagggactatctgtcttcaggtctgtaatgcccctcaagatgtcaaaacatcataatatacagaaaataaaaatcatagccaggcgtggtggctcatgcctgttatcccagcactctgggaggccaaggcaggcagatcacttgaggccaggagtttgagaccagcctggccaacacgtcgaaaccctgtctctactaaaaatacaaaaattaggcaggtgtggtggcacacacctgtaaatcccagctactcgggagactgggggatgagaattgcttgagcctgggaggcagaggtggaggttgcagtgagctgaggttgcaccagcttgggtgagagtgagactctgtctcaaaaac

SEQ ID NO: 39262 - DNA, 458 bp, Homo sapiens
accaaaaactttcactctttggattaaagtgctctatgcatcaaatcccagtgggttttaaaattatactgaatctaggccaggcacagtggctcatgtttgtaatcccagcacttaaggaggccgaagtgagaggattggttgaggccaggaattcgagacaagtctgggcaacaaagtgagatcccatctctacaaaaaattagccagactggtgggctcccttagcctcagctacttgggaggctgaggtgggagattgcttgaacctgagaggcggaggctgcagtgagccaagatcacatcactgcactccagcctgggtgacagagcgagactccaccacacacacacacacacacacacacacaaaatcagcaaactttgagtaaagcagattccccctccattccctctattatgtcagtgggcctcatccaatcagtggaaaggcctta

SEQ ID NO: 39263 - DNA, 148 bp, Homo sapiens
aaagccagtgtacctgtgatgggagatcaatcctgacagctcacagaacgagtctggtcttctgtggagcacacctgctaagtcccagactctgcagcaagcctggctggcttcacatcacactcctgatcttcggggtgactttgaa

SEQ ID NO: 39264 - DNA, 394 bp, Homo sapiens
ggacccagacatgggctcttcatccatctgctactgtgtgacctcaggcagggtgtccaacctctctgagcttcctccgtggtaatcccatcccatggccaccccgtggaccattgctgggagaattaaagatgatggcatgtgaaaaccctctagggcactgcccaaaacacagtaggtgctcaacaaacagcagctggggacctcccctgctaggtacactgccatgccctcatctggggacacccctgccaccctaaccgcagacagactggccagccagggatttgaaattccagagatgtctcccctttccccggcaccctctccaaccagcagcacctcctggaagcagcaactcagggctgttgctcactggctcaaatgtggcttt

SEQ ID NO: 39265 - DNA, 431 bp, Homo sapiens
cactagcatcctggggaggaaattaaagcattcgtcgagggcctgactcaggaaagggtagaggaatggattatgtcagccacaggagaccaaggtgagagcacgagggaaggagcaggaagttcgacccttgagtagcatccggaagcatgagaagtggtgaaaagcttgagcgatgagttttttaatatgatacttctgtggaacaaaaattggtctgtctcccccaaacttcagcaaagtctgttatccacacaaaagctttagtgagagtttttttttttttctacctcagagcaaggggagttgtgaaaatgagtaaaacggctgaactccctcatctgggtcaaggcgatggggagcatgggatggcgcgatgtagaagtaaggccccctgtgagctggggaagacatggtcgggaaaacccata

SEQ ID NO: 39266 - DNA, 433 bp, Homo sapiens
atgtgcaagttgtatgcatttaattctttgaagtccaaacacattcttgcttgaaagaaaagctctggaggatgaaataagagtatacaattattgcaaaatggtaataaaatcacctccccacgcttcccttgagaaccatggtcaaggaagatctggctgagagggctgaaacagactgtcaacttgacttttaattttatgaactatgagaatttggacaaaaaaaaatcttcaaaggatcaatatcatttctacaaatgagaagaagactgagtgtgaaaacgctgctttgaagcaggctcagaagaaaaaaatcttatgagcaagtaccaatagaactttctcaatttctcatttttttttctttaaaagggattttatttcttttaagcacaggaattgcagttaaaaattattttataacccttaa

SEQ ID NO: 39267 - DNA, 422 bp, Homo sapiens
tgttaaaactcacttgtgtctcacattaagctcctaaatgtgccctctgtttccctaggccagagccagtgtctaacaagtaatgcatttggagggtcatggcccaacagtctacattcagccaggatttaggaacttcattccaatgatctttgaaggacttgtacaactctagccagcctttgaagggagtattttgggaactgggaagagatctttctagtcctcccatggagacagcaaggttatggtgaagtttggaatcagataaaactaatggaggcattacatctctaatctaaaatgaggattatagtctaggtgtggtggcacacacctgtaatcccatcactttgggaggccaaggccagaggattgcttgccaaggagttggggaccagcctgggcaacatacagatgca

SEQ ID NO: 39268 - DNA, 126 bp, Homo sapiens
acactggtgctctggtcgccgggtcagagactcactggggacgcatgtgattcacactggtgcgctggccgccgggtcagagactcactggggacacatgtgattcacactggtgtgctggccgcc

SEQ ID NO: 39269 - DNA, 1764 bp, Homo sapiens
gcagccctgcagagatctaagaaaaaattccagaaaaatgagcagcaacctccaaggccaggcatcggtgcaggggacaaggggtcgtagctggaggggcctaggtgaggctgccgggaagggacgatgtggttggtggagtgcacaggcagggacctcactggactttcctgtctgctcggcatggacaggcagcccaggagaaggcagcacgtggccgggtgcagggacgtaccacccccacttccccaggggagctggggcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaatgccagaggcatgggcattaggtccccccggccagcctccgttgccacatgggctatttttgtccatcgcgtgggacaacctagtattgggggaaaactcagtccactctaaagaagcatcggcgttttggatggacgaatgctgcttcatgcgactccatgtcaatggactattttattcaactcgggtatttatgagtgtctcctctgtgccagccacgtgtgaaagaagaactccaagttactggacaccaggacaaaccaggagtctcgctgtgtcacccaggctggagtgcagtggtgtgatcttggcttactgcaacctctgcctcccaggttcaagtgattctcctgcctcagcctcccaagtacctgggactacagatctttagataagcactctttcaaccaaatgccaatcagaaaatctttgaatccacctgtgagctggaagccccgctgtgctttgtgttgtcctgccttttcggaccaatgtaaatctcacatgtactgattgatgcctacatctccttaaaacgtataaaatcaagctgtaacccaaccaccttgggcatgtgttctgaggacctcttgaggctgtgtcactggtcatgatccttaaccttggcaacataaacttctaaactgattgaga

SEQ ID NO: 39270 - DNA, 2559 bp, Homo sapiens
gcagccctgcagagatctaagaaaaaattccagaaaaatgagcagcaacctccaaggccaggcatcggtgcaggggacaaggggtcgtagctggaggggcctaggtgaggctgccgggaagggacgatgtggttggtggagtgcacaggcagggacctcactggactttcctgtctgctcggcatggacaggcagcccaggagaaggcagcacgtggccgggtgcagggacgtaccacccccacttccccaggggagctggggcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaatgccagaggcatgggcattaggtccccccggccagcctccgttgccacatgggctatttttgtccatcgcgtgggacaacctagtattgggggaaaactcagtccactctaaagaagcatcggcgttttggatggacgaatgctgcttcatgcgactccatgtcaatggactattttattcaactcgggtatttatgagtgtctcctctgtgccagccacgtgtgaaagaagaactccaagttactggacaccaggacaaaccaggtagatcactgcatccggttcctcctctttctgccgactctcccgggcaaccgttctgattcctggcatggagttgggggcgagctcatcagtacccagagcgcctggtgtgcagccaaaggcccccattttattagtcggtgtgttcagtatcacgctcaagacaagggccaacctattacttcacacacctcaaatacaaaaagtgcctgggaacgtcgatgaggtattaaaggaaaccactggtcttgtcagtcatgtacacacagaaaaaaaaaccagtcatttttatttttattttttgagacagagtttcgctcttgttgcccaggctggagtgcaatggtgcaatttcagctcactgcaatctctgccacccggattcaagcaattctcctgtctcagcctcccgagtagctggaattgcagacacccatcaccacgcccagctaattttatgtatttttagtagagatggggtttcaccatgttggtcaggctggtcttgaactcctgacctcaggtgatccacccacgtcaggctcccaaagtgctgagattacaggcatgaaccactgtgcccagccgaaaacaaccaagaattttttaacaataaaatgaccagcaagtaaacttgaaacaaaaatggacaaatatctaaaatatttttaaatgtatgtattttaattggcaaataatacttgtatatattgtttacaacttgttttaaagtatgaatacattgtggaatggctaaatcaagttaattaacatgcattaactcacatactttttgttttttggtgtggtgaggacacttaacatctactctcttagcaattttccagtcaccatgtcctactatagatccctagaacatattcctccaatgtaactgaaatgtatcccttgaccaacatcactgcccggccccagccccaggtaaacaccattctaccctctgcttctgtgagttcagcttttctagatttcacctgtgagtgagattgtgcagcatttgtctttctgtgcctgggttttttcacataatgcccttctggttcatctatattgtcatatatggtagcattgtcttcctttgtaaggctgactggtataccattgcgtatatacaccacattgtttacctaaaatattttttaatacaatcgctgaaaactgcca

SEQ ID NO: 39271 - DNA, 2631 bp, Homo sapiens
  misc_feature (2631)..(2631): n is a, c, g, or t
gcagccctgcagagatctaagaaaaaattccagaaaaatgagcagcaacctccaaggccaggcatcggtgcaggggacaaggggtcgtagctggaggggcctaggtgaggctgccgggaagggacgatgtggttggtggagtgcacaggcagggacctcactggactttcctgtctgctcggcatggacaggcagcccaggagaaggcagcacgtggccgggtgcagggacgtaccacccccacttccccaggggagctggggcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaatgccagaggcatgggcattaggtccccccggccagcctccgttgccacatgggctatttttgtccatcgcgtgggacaacctagtattgggggaaaactcagtccactctaaagaagcatcggcgttttggatggacgaatgctgcttcatgcgactccatgtcaatggactattttattcaactcgggtatttatgagtgtctcctctgtgccagccacgtgtgaaagaagaactccaagttactggacaccaggacaaaccaggtagatcactgcatccggttcctcctctttctgccgactctcccgggcaaccgttctgattcctggcatggagttgggggcgagctcatcagtacccagagcgcctggtgtgcagccaaaggcccccattttattagtcggtgtgttcagtatcacgctcaagacaagggccaacctattacttcacacacctcaaatacaaaaagtgcctgggaacgtcgatgaggtattaaaggaaaccactggtcttgtcagtcatgtacacacagaaaaaaaaaccagtcatttttatttttattttttgagacagagtttcgctcttgttgcccaggctggagtgcaatggtgcaatttcagctcactgcaatctctgccacccggattcaagcaattctcctgtctcagcctcccgagtagctggaattgcagacacccatcaccacgcccagctaattttatgtatttttagtagagatggggtttcaccatgttggtcaggctggtcttgaactcctgacctcaggtgatccacccacgtcaggctcccaaagtgctgagattacaggcatgaaccactgtgcccagccgaaaacaaccaagaattttttaacaataaaatgaccagcaagtaaacttgaaacaaaaatggacaaatatctaaaatatttttaaatgtatgtattttaattggcaaataatacttgtatatattgtttacaacttgttttaaagtatgaatacattgtggaatggctaaaaaaaaaaaaaaaaaaaaaaaaaaaaaaaaaaaaaaaaaaaaaaaaaaaaaaaaaaaaaaaaaaaaggaggggggcgcgcgcccccaattcccccccggggggcgccccttgccccccccctttttttaagggggcgccccccaaatgggaggcgggttcataataaaaagcacagcagcagacgagcgcgccgggttaaaacaacgggcgcgggtggagtggggagaataccacgagctgttcatcggggtgaacttgtgatgtgggagagagacacccccattctggcggcggggggggcgacactaattgtgggaacgacaacacaccagcgagaaattataaaccctccgcggggagaatataataaaaccttgcgcaggagagttgcagtggctggctgacccaccaccgacaatgagtccgcggccagagaaaagctgggccacagacgaagatagtttaggaacacatatgtccaccggagcaggtagagaan

SEQ ID NO: 39272 - DNA, 848 bp, Homo sapiens
tatcttttagagaccggatctcactctgttgtccaggctggagtgcagtggtatgagcacagctcactgtagcctcaaactgggctcacgattctcacactccaccctccccagtagtgaggactgtaggcacacaccactacacttgcctaattaaaaaaaaatttttttttttagagatgggatctcactatattgcccaggctggtctcaaactcttggacctgaagtgatcctcccaactcagcctcacaaagtgctgggattataggcatgagccaccatatccagcccaaaaatcttttaatattttttgcatattaataacctagcatcaggctacactacttgaatgctgaaaagagctaaagttctcttcagcacagtttgcaatattgtgtgttcgaggagtcagttgaagttgtgtggtacatggcattaaacaaaaagggaacgtgtcaatatcatctaacatggttgtgttaaagaggaaaagtattcagtctttgctttcacacctctcttagataatgaacagttactgaacaatgcatttgtaagtaagtgtgctgtatttgttacacccaagacagctctagctgtgttcaagcccagctggatgctagaactgcgagccactgtgaccttgccgtgtgagggtaagtgctccacacaacctggcagttgattattttaatgttgtagtatcaggactcttcccctagaagagtcagaggctttcttcttactttcagatgacaacagaacaaatttttacgagtaaagcaaacaaacaatggtccgattagaaaatcaaataaaaatttacaagtagccaaaactcaaaa

SEQ ID NO: 39273 - DNA, 985 bp, Homo sapiens
cctagagggaggaggctgagcaggcagagaatgggacgtgtcccctcagaggagcctcgagcccagttccagccagcggcccactcagtgaggtgctcaagtacccacgtcccccgccagctgccagggttccctctcctccctccgtccctccccccatctggggagcccagcggtactgagggggcggaacgaggcggggccaccgagcggttatagctgggcctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtggcagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctgacagcgtcccccgcccgcccgtggcgcctccgcgcctgacccaggaggagtggccgcgcgcttccaggagccgctcatagaccccgcctgccgtccggtcaataaaatccgcctgactcctgcgcccccgc

SEQ ID NO: 39274 - DNA, 555 bp, Homo sapiens
ggccgctctaccatgagccgaccgctcgaaggtccgcgcggccacgcggccagccccgggctcctctgggccacgcgtgtcacgtcaacactcgccgggctccacgaactggcgttgtcagatgaaacacggcacaactggtttgcatctcagatgaacaaggggtcatgtcttagtcccgcgaggctcctctcctgctgccctcgtgggttcaggagctgtggcagacgcgacgcaggagctcccaggcagggatccccgtccgtgcgccccggagcccgcgcgccccagagcctgcgctggaaccggagtccctggacttcagcggagctggccagagacttcggagagacgtctcccgcccagcggtggaccccgcagcaaaccgccttggcctgccctgcctggcccccggaccgttctgacagcgtcccccgcccgcccgtggcgcctccgcgcctgacccaggaggagtggccgcgcgcttccaggagccgctcatagaccccgcctgccgtccggtcaataaaatccgcctgactcctgcgcccccgc

SEQ ID NO: 39275 - DNA, 279 bp, Homo sapiens
tacaatgtagggtttttgttgttgttatttttgttgttttagcctactttgggaaggtggaatgcgtagtgggttcagaaaatttggagcaccgtgagtgacagatgtctactgcaataattaccctgcaaggctgggctgggtgcagtggctcacatctgcagtcccagcactttgggaggccaaggtgggtagatcacttcaggtcaagagaccagcctgagcaacatggtgaaaccctgtctctaccaaaaaatataaaaagtagctgggcatggt

SEQ ID NO: 39276 - DNA, 373 bp, Homo sapiens
acattaattctacagtaactcaagaactatcatgtgtagttacctggccatataaatgataataaaaatgtgatagtttttagttttgttaacaaattctttttttttgttgttgagacagagtcttgctctgttgcccaggctggaatgcagtcacatgatcttggctcactgcaacctccacctcttgggttcaggttattctcatgcctcaccctcccaagtagttgggactacaggtgcgtgccaccacacctggctaatttttgtattttcattagagacagggtttcaccaggttggccaggctgacctcgaactcccggcctcatgtgatctacacgcctcagcctcctaaagcactgggattaca

SEQ ID NO: 39277 - DNA, 783 bp, Homo sapiens
cacccgccacgatgcctagctaaatttttgtatatgtggtagagatggagttttgccatgtggcccaggctagtctcgaactcctgaactcaagtgatccacctgctttggcctcccaacgtgctaggattacaggcatgagccattacgtctggcctagttttctttaaatacaccgtgtttactagcttaaattttgtgttgtttattactaaagcagaaaataatttagggtcttatcctgggtaaaatagccttccatcagatgagtacaaagcaagaacttcataagaaattgaaatgaagattcaaactgttaaagaaatgatttagtttcactttcctattaattattgagtaaatataaaacatcattaacactttgtggcctctctcagatgcctacaaagaaggaatgggtaggcatttatggtttatagttgcctcatcatgtaacatattatatctcagctctaaaagaaagttctatagaagattatagatagagattttgataactggaatgtagtatggatatagggctggtgtacatatacattttgaaattgctcttacaagattaaatactattatagaccagatgatgtagtaaaatggaatttcacttgccattgtgaaataggtgaaacaaattccagtttccttagatttcttccctctactttatgcaattatcactgattttatttttcgttgtaacaagtagttatttgttgtgtggatttcttaaaattgacatttaaacaataaaatcctgaaaag

SEQ ID NO: 39278 - DNA, 160 bp, Homo sapiens
cagaactcaccaaaaccagctctacatgtcattcccatctgctcaagccttaatactgacttcttccaatagaataagccctgcatccaaacaatctaatgctcacattttcattttaccagggaggaaacaggcttggagaagtaacttgcctgtgagc

SEQ ID NO: 39279 - DNA, 418 bp, Homo sapiens
tgagacaagggctcactctgtcacccatgctggagtgcagtggtgctatcttggctcactgcaacctccgcctcacgggttcaagcaattgtcctgcctcagcctcccaagtagctgggcttacagatgcacgccaccacacccagctaattttttttgtattttttggtagacatggagtttcaccatgttgaccaggctggtctcaaactcctgacctcaagtaatctgcccacctcggcctcccaaagtgctaggattacaggcgtgagccacagcacccagccctgtttacatttcttgactgtgaacagtgctgtatatggtctgtaagtgtgtaggtatgaaagttttgttaccttctggacccaattttttgttaataaaaaaatcatttaattattaattaaatcattac

SEQ ID NO: 39280 - DNA, 869 bp, Homo sapiens
gtggaggtgacactgggcgccttagaggagagagctgcgtgatgtatcaccactcaccagcccttgccggagacctgtttagagtgagattacagtctcagcagagcctctcatttctcctggtcacggggttacagagcactttacaacttgtgctacaggaaggcagggagggatttaaatgagagactggaagagaccctccataaacctcagccagagcagccctgactcacagatgaggatatagcaagaagatggtcatctgcaaaccaggaggaggatcctcaccagaacccaaccctgctggtaccttgatcttgaacttctcagcctccataacagctatcaacagggtaatggagtatggagtcacgccgatggagatttgtcttagatagtatgattagggaagacccttctgaattgagacctaaaggacaagaatgagctgcccacaaacaaaacaagaagaggataccagacaaaggatagagtgaagaaagaacattctcattcttccttctatgctgatggtacaagaaagtcctggaatcctaaggatctaggaaaaatcaacttgagaagtttctatgtggaagaaaactggctattagcttgggacttcagcaaggcacttagcaaggtctctcataatatcctgtggtcaagaagaaaaatataggctggatgactgtacaattaacatgattcatagctggctggaacaacttatgccaaaaagtgccaattaatggacggatatcaaactgaaggagctctccagatgttctacagcaatttgcctcttgcccagtggtgcctggtacctattatcaataacttggataaatatatagaatagttat

SEQ ID NO: 39281 - DNA, 307 bp, Homo sapiens
gaaaaaatgatttaattcaatttttatcaactccagcactattttctctattagagactactgtcattatccttctggtttctgttttaaagatactgattaaggaattttctttatagttccacataacagttggtcttctggtctgaaagtagtattacaggttttgttaggaaaacctataatacagtgttgcctgtcaccgtcattatagtgagtttgtgtttgtttggttttaaataaggctgaagcatcaatggctctttctgaaaaaattgttctccaaaagtaaagtgtgagctataga

SEQ ID NO: 39282 - DNA, 390 bp, Homo sapiens
aagacaggacttaccagactaggcctcatagagaacataagattcaaacttgacattgaaagatggataagacagtaggacacatgaatatgtatttgcgggggctgcaattttggaacacccactttataccagttattttcatatattacaacatttaatatctgtaaagacttttgttgtgattgtagggaaaagttttaggctaggcacttaggttactttacaagcatgatatgattgggtgataattattgcatcattccccaaggtagaattatataggtttctctgacctcaagaattctttgatttccatagcataagaaaagatttgggggaaaaaaatgaagaaaagagaaaggagcgaggaaggacatgctgtggaga

SEQ ID NO: 39283 - DNA, 321 bp, Homo sapiens
ggttgattccatagactgaaacttttaaaaaataagtaggatggtgttctctagtggtttgcttatcaagggactgcctccataaatagggtgaccattagtctgattggtttgcaagagagtccctagtttatgcctcttgaaccagcatatttttaaagagctcctcatttcataattaagtatcctggtttggacaataagttctatggtcgctgtactaataacatatccaaggctcaaacaattatttagctttggtatctctattatcagatgaaacagaggttaaagcacatcagtttagaaacattttttatc

SEQ ID NO: 39284 - DNA, 173 bp, Homo sapiens
taatagaatagacaaaaatagaaaaggaaaccataaatcattttcttaaacgatcaagaaaattaaacattcagctaaactgagcacaaaaaagggagagaagactcaaattactaaaatcaggaatgaatgaggggacattacttctgaccttccagtagttaaaaaaaaaa

SEQ ID NO: 39285 - DNA, 381 bp, Homo sapiens
tccaggcgcgagatgatgtggactgaaatggtgtggagacagtcggagggaactgcgagatcattgggtgtcagactgggtttgcaaacctacgacttcactgagaagtgagcaaaatgagtaacctgttcccctcaagcaatacagataatgtggagagatacttgtttccactggaacttcctcctccaccgaatccgactgctgtacctgtgtggataggtaacctacagaccgactgccccacctcaggagtcctgtgtgcttcacgactaaaatcctctggcactttcagcctcattgaagagagatgaaatccagttggctgtaaccagggacctggagtaatgtgatggtgtctattaccagggaatggtggtg

SEQ ID NO: 39286 - DNA, 479 bp, Homo sapiens
aaaatcactcataaacccaatttactaaattagaattgtagatattttccagtggcaataccctcttgtttaatcttgagccacccctcctcagagttagggcacctggaacaaagtattgtcatcaaatgtctgcaggtgaacaacaaaagaacagtggggggtgtatggcagggtattccatccaggcccgaaaagtcctgcctcaccccagaatactcacctctgtgtatccattcatccaacaagtatgaattgtgcaggtaccatgtattcagcaaactccgtcaggtcgaccttcaaaagaaatctcagtccagtacttcacgccacctgcacagtaatcatctaattcaggcaccatcttctcatgcctagagaaatggaacaggcccctaactggtctccctgtttccacctactgttcattcttcagccagcagtcagtctgatccttctaaaatgtaagtcagattacg

SEQ ID NO: 39287 - DNA, 362 bp, Homo sapiens
ggtaaaatggggtaacagttttgctgaaatcccccatttattatagaacggtgactctgggatgtattttctagaagctgaatagaatttacttttgagtttgggttattttacagtcttgtgctggcattattcatcagtatgactagtatcacacattgctttttctagtacagtaaattattaagagttacaagttcagggaatagctttatcctaaagacgaaagtggtaagagttttaaaaacagccaggcagcttttgccactgttttactggagaacattcagatgtctgtcattgagctttagaatgggtgtgggtggcagatggagttttccaggttgactttgttcagaatc

SEQ ID NO: 39288 - DNA, 430 bp, Homo sapiens
aaattctctcagcaatgagttgtgacaacacgtggaaaatgttgccaatcagagaagctcactagagactcagcacccaaagttttaactgggggctgatcatgtaggcagtctctacctggcaagtaccaatattccagactcccagagataaaccacattgttttagtataaaccatgttgtttgcacagacaatttaggcacagagagccactcttactcattccaggaatggtaggaaccctcccaaaacccaagttacaaatactagtcaaaggctaaccttatcagcaggcctttcaaagaataacagccagacctgctatgttaactcttttctacattatcagttataatttttaaattttattttattttattttattattttttttggagacaggatcttgctctgttgaccaggctgga

SEQ ID NO: 39289 - DNA, 308 bp, Homo sapiens
taggttgactaaaaatgcacatatccatggctgagacaagaatctgtaactgacaaagcagagaataatagcacccgggaatgtgttggtgggaagttttagttcttacatgttgccataaacccccaggagctgtgttgcagcccctgctttttccctgtgcatagaagcacagctgtgtctagataacagatagaaatctcttgtttttgggaaggtaagcccctcagtcatctctatggcataattcctgatcaagctgggccagtcatggcaattctagcccactttgcttctgattggcctac

SEQ ID NO: 39290 - DNA, 421 bp, Homo sapiens
tcagagctggtttctgcgaccatcagaatgcatcagcactgtctgtgttatctatattgtgggatttctcaaggctttcaatatgccaatgttaactgtgactctccaaaaagggtgtagtgtttcccaaatgtatttaaccatggaacttaactcttattttcttttgtcagagcatctctcagaacaagtctctagggacatatagcttgggaaactctgaaacacagagtcacaaaaagcataatgtttataatctagaatatctctgaggatcttaatccaaactatgttgctaatattaccatgaagtaactggtgagagtaatgagatgtaatgattttcatattttgccgatgaggaaactgagatgtagaaaattcaagcagatttcccatgattgctccgttgagaaatgtt

SEQ ID NO: 39291 - DNA, 881 bp, Homo sapiens
ctgatgaacattcttatcagttgaggacccacatgttaccttgtcctatttttgtctgttgtcccagggtagcagcctgtgtacatgggtatgtggcacttttgtaagaattagaaaaaggtatccccactctcaccttagctgaaggattaggaaaaagtgaccccttacgcctagatgcagctccaaacagacagcagatgagctttgtctattggatgtctttgctctactgtaatattgtcaaaaaacaaaggaaatgactacttagtgaattgtggttcatgtctacaaaattgtgtcttccttttctaagtatccagatgtcattttaataataggtttattcatttgttcagtatctgtgaaaagtttcttgcctcggtttcagactaaggcaaaaactggaactccatctgtccacctccagttttttagtgttcatctccctctgctgattctagctgagagtccttattggtaaactctccttgctgagatggaaatttactaggcaagaagaagttaagctttagacagctaggacatattttcttacaagcttcttcacctatcttttcagttaactctttgaaagcttattttatcccttacatttaatggtttatttttacataatagagaagacaaaaaaaagggaattagttttgtttagtcatccattttatctcaagcagaggcatcccttccatgttcttcttgtctgaacaaaacaaaatgttattttttgttgttgtcgtccttagtttattcttggctttagcctaaaataacagagtaacaatattacagggctgttacaggtatgcggcttctgttctcctcttgagtttaattcattaaactaaattttaaaaaaa

SEQ ID NO: 39292 - DNA, 669 bp, Homo sapiens
gcggccgcctactactactaaattcgcggccgcgtcgacgatttttacgtctattaaaagtacataaaggctctggaagcaaaatgcctagtttgcaagttcttctatttagcagctatataatctttagatagatgaatgatttttgtatgtcttagtttccttatctgtaatatgggactagtaatacaggtatttatattaaagatgagttcagataatcatagatggagagactcctggctctgttggtttgaagaggtaggcagatctttctgcaaaaagcaagtataaaactggaatgtattgtcaaaaacattacatcagggctctggaaattcaccaaagattaaaaaaaaaacacacattgggaaatattttttcctgaaaaattgatagagcttcaggtaaaagcagcggaagtctgtggccttcttgccaatacacatgtacccacatgcttggtcgataagatctgtagtttgttaccagagtggcactgcgtgcaaaaaccagaagctttgttgtcagagagaatggattaagtggctcatgcctgtaatcctagcacttatgaggcctaggtgggggattacttgaagtcaggagttcaagaccagcctggccaacatagtgaaaccccgtctctactaaaaatacaaaaatgag

SEQ ID NO: 39293 - DNA, 10007 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagagagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagatcgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctatttaagaatttct

SEQ ID NO: 39294 - DNA, 6740 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagagagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagatcgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggtaccgacacctcccaggccctagagcactggtctgtgggcaaggggcaggatctaagccaggcctggaagtccaagggactgggaggggaaggacccaaccaaaggccgagggcaccaccgtgcaagggggtttgggaacgctggggtgacgctgagactggagggggaggtggcactggggcggatggagtgggcggggctgggtcctggggacagcagagtgtggggaggaccccaaggcgggtctggaagaggcctgtgatccctagcttgaggggaggggaggagaggaggaggagtactggaggttttgcagggtggcggggtgctggcagtggggaggacaccctgggtgctctgggtgggtgtgagtgggggcttgattactaggaatggaggtgggagggcgggtctggtggatgagaagcctcgggctgcagggtcccccgtactggattggccagggccacagccctcctacccacgggcacacagaggtctgaagcactgagggctccgctgtgggggtggggaaatggggccgggccggctcccacagtgagtgcagttgattcactgggtgactgtctgacccgtcacaccaggctgtgtgctctggcgggcaggacacaaactccctgcctgccgggctcactgtttagtgctgagagtgagctgcctgggtgcaggagggatgataaccaaaataaa

SEQ ID NO: 39295 - DNA, 6635 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagatcgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggtaccgacacctcccaggccctagagcactggtctgtgggcaaggggcaggatctaagccaggcctggaagtccaagggactgggaggggaaggacccaaccaaaggccgagggcaccaccgtgcaagggggtttgggaacgctggggtgacgctgagactggagggggaggtggcactggggcggatggagtgggcggggctgggtcctggggacagcagagtgtggggaggaccccaaggcgggtctggaagaggcctgtgatccctagcttgaggggaggggaggagaggaggaggagtactggaggttttgcagggtggcggggtgctggcagtggggaggacaccctgggtgctctgggtgggtgtgagtgggggcttgattactaggaatggaggtgggagggcgggtctggtggatgagaagcctcgggctgcagggtcccccgtactggattggccagggccacagccctcctacccacgggcacacagaggtctgaagcactgagggctccgctgtgggggtggggaaatggggccgggccggctcccacagtgagtgcagttgattcactgggtgactgtctgacccgtcacaccaggctgtgtgctctggcgggcaggacacaaactccctgcctgccgggctcactgtttagtgctgagagtgagctgcctgggtgcaggagggatgataaccaaaataaa

SEQ ID NO: 39296 - DNA, 4560 bp, Homo sapiens
gaagtcactaactgcctggggcatccagtgggcattcggaggtggattcctttcacgggattttggaagatggtcaggtagaggaggtgagaggaaggtcagactagacatgagggtagcctagttaagcaaggggccgtggagcaggtcatgaggtacccttcatgagctgtcccccttcccagtcctgccccatcctacctccctttccttgcagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctatttaagaatttct

SEQ ID NO: 39297 - DNA, 1224 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatacccctcttgcctgcacccccatatggtcttcccagagtgagctcatccacctcgtcatgcctgactgcagcttca

SEQ ID NO: 39298 - DNA, 456 bp, Homo sapiens
gaaaaagatagttagtttcacattgtcattcctctgcttttcagttctgccattcttagggtgtgatatctagcctccagagcactttagggtccatgataactgctggacctccagccatcacatctgtattccagaaaggaagtaggagatggatgctcatctctcctactgttgtaggagaacaggctcatctcattctcttgtgttcattgttccaaaaggacatacacagaagatgttatagaaggtttgggggcaagatgtcaggacacgtggtcagagccctaatggatgagaaggtgctgggcaaagagccagggaaagggaatctcagcagggcaaacagcacatgcaaacgccctgaggtgtcagagagtgacctggcaggggcacaagaaaggagaaggggagtagaggtgggcagggctgggccacaggctgtgttgggcactg

SEQ ID NO: 39299 - DNA, 440 bp, Homo sapiens
tttttttttttgagacggagtctcgctctgtcacccaggctggagcgcagtggcgtaacatcggctcactgcaacttccgcctcctgggttcatgccattctcctgcctcagcctcccaagtagctggaactacaggtgcctgccaccacgcctggctaattttttgtatttttagtagagatggggtttcactgtgttagccaggatggtctcgatctcttgaccttgtgatccgcctgcctcggcctcccaaagtgctgggattacaggcgtgactgtccaacattttctatattcttcttccagtttagaggggctcctttccctgtctatttagatcccattttcctcaaggcctggctcaaaatattaccaagaagcctctgccaactagcagaacccacattaattcccctctcctttgaattcccacagttct

SEQ ID NO: 39300 - DNA, 524 bp, Homo sapiens
tcaaaaatgtggtgatactgtggtgctggcataaggattgacaagtagatcaatgaaacaaatagtccagaaataatcccacactaccattgtttgttttttttgaaaaaggcaccaaagcaacccaataaggaaaggagactgttttcaacaaatggtgctagaataacttgatatccacatagaaaaagaatgaacctcaaccactacctcataccataacaaaaattaattcatgatggatcatagaacagtatgtaaaagtcaaaaccacaaagcttttagacaagagattatatccatgacttaggaattaacaaagctttctcagacagatagaagaaaataatcataaaaagaaagaaatggtaagttagacttcatcaaaattaaaaacttctcatcaaaagattccattaagacaatgaaaaggcaaaccacagattgggagaaaatattcaaagaacatgtatctggcaaaggacatataaagaagtcctataattaaatatatattaaaaaaa

SEQ ID NO: 39301 - DNA, 344 bp, Homo sapiens
gacgacgactgattttgctgagtggtttgaaaagcctaggggaggccaagtaggggagacttactgccaggactatctctccaagctcagttcctggggcttccaccctcacattctagaggaaagcatattgccactcagccaagttgtgtgatgtgattactagtgaaacgtgatcagctctgggggccctcggctcttggctgtcaatgcaggatgatactgggctacaggagaaagaggtaaggaagacagagtattcccccatgaataggatggaatggattaaagtagaagagaaagtaaagtgaactacctcatttgtcatgtggggaagttcaggc

SEQ ID NO: 39302 - DNA, 346 bp, Homo sapiens
tcagtattgaggccccaagcctggaagttatcctccatttctcttttcctctttggcccctcctccaatttattaacaagttctgtcagctataactccaaaatatatttttaaaatatgaccttttttcctaccctagctcaagtcctcattatctttcttgcttagatgtcgcattagcctccaaactgtcccccggggccactcttacccttagtaccatcttccttccacacaatgggcagggtgggtttttttagttgttgttgtttgtttgttttttgagacagggtctaagtctattgcccaggctgcagtgcagtggtgtggtcatagctcattgcag

SEQ ID NO: 39303 - DNA, 595 bp, Homo sapiens
caaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaa

SEQ ID NO: 39304 - DNA, 428 bp, Homo sapiens
tgcaattatttattttcttttaatgtatcctaattgtatataatcattgctgtccaggcaaacttctctgttgtgtcccttctttcctttgtgtgtgtgtgtaatttagttattcatgctaagggaggctccctaaactccacctctttaaattaatagggatttttctcatcttaattctcatggttagaagatatgaatcaatataattctttcctaatacttacatgccttcgaaagagaagatttgacagttgcatgaagtgattggttttacacacgtaataccttgatgaagagagtttcttggttggtcgcagtggctcacacctgtaatcccagtactttgggaagccaaggtgggtggatcgcttgagtccaggagtctgagaccaatgtgggcacgatggtgaaaccctgtctttaca

SEQ ID NO: 39305 - DNA, 394 bp, Homo sapiens
ttatcaggtgactggacagaagagctggtgatactcaggtgggggttgaatggggcagttgtgaggcacttgtggacattagagaggtagagatagagagaggagagaaagggctgcataaggacaacttagtttattttggaaggctgttacactttgacctccatttaaaaaacaaacaaaaaaatctaaaaaccccaaaacgttgagggactgttcccaagccccagcatctttgccccatcctcaagccttccaggaccctctctccattcttgggattgcagctcctaacgtagttctcctcttcagctcaaggacaattctaactgtcttcttgcctggtatggcttaatgagcctcaagctcacttagcatcatctggatttaattt

SEQ ID NO: 39306 - DNA, 4189 bp, Homo sapiens
cgcgggcggcggtgctaggctcgcctctgcctccctcgtggcgggcccggacatggggtcccgtggcctgagtccctcggccggcgcgcagggctcggggccgcgcgcaccttccccgcactgactgtcgcgccgtgccctgcgccaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 39307 - DNA, 4531 bp, Homo sapiens
ggcgtcggggagggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtgaatgggtgagctgggcatggtccgaggccaggaggggagcggccctggtgggtacagcagtgagcctcacccgtgccttctgcccaggtacacctgccctttcgtggagaaattctccattgaaattgagacctattacctgcctgatggggggcagcagccaaacgtcttcaacctgagcggggccgagaggagacagcgcatcctgggtgaggcctggagctatggggggaccctggcgcccctctcaggctcctggctgcctcagtgggcagcctctgagaagtcccagccctctccaggcctcatgtcctgtctgcaaaaggacgggaactgtcatccagtcccaagagggtgccaggagcgggggctcaaaggggctggcgctgctcaatgcttgccgaactccctcagacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 39308 - DNA, 4334 bp, Homo sapiens
ggcgtcggggagggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatcattgagctttacgccactgggccccaatcaatacctcaggggggccggaccaattcgcctataggagtctattcattaatggcgtgtttacagtttgatgggaacctgggtccttattctggtgtc

SEQ ID NO: 39309 - DNA, 1572 bp, Homo sapiens
gtgcagatgggtgtggggcaggaggccatcctgactcgctgccatgccgcgcagtcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 39310 - DNA, 1566 bp, Homo sapiens
ggcgtcggggagggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgggcgcagaggcttttccagtgtgtataaatccatgaaaataaacgccacctgcacccca

SEQ ID NO: 39311 - DNA, 321 bp, Homo sapiens
gtgaggcccaagtgaaggccaggaacaggaccccaccagggggcagggccctcagtcccaggccttgggaaccacggactctggggaagatgtgagaaggcctaaccggcctccagggaacctgggatcctccgaggcacaagggccatgagcagcttgagctgccagctgccaggcaagccagaggggacagcccacactggaaagtgctcaagaccctaggcgctggttccactcggccatggctttccactgtgacctttctgagcctcagcttcccatctgtaaatggaaatgatcatggaactgcccatagtcagc

SEQ ID NO: 39312 - DNA, 4236 bp, Homo sapiens
ggcgtcggggagggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaacgtcacttccaaccaccgggcgagcgacacggtggtgtgcgagggccgcccccaggtgctaagcgggcgcttcatgtacgggcccctggacgtcgtcacgctcactggagagaaggtggatgtctacatcatgacgcagccgctgtcgggcaagtggatccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 39313 - DNA, 4077 bp, Homo sapiens
ggcgtcggggagggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagccttcaggcagcccccgcaaccacctcctcctgggagccccggcgggcaagcacggccttctgcccacccgctgccagttccgaggcacctgacggccccagcagcactgcccgccttgacttcaaggtctctggcttcttcctcttcggctccccactgggcctggtgctggctctgcgcaaaactgtgatgcccgccctggaggcagcccagatgcgcccagcctgtgaacagatctacaacctcttccacgcggccgacccctgcgcctcacgcctcgagcccctgctggccccgaagttccaggccatcgccccactgaccgtgccccgctaccagaagttccccctgggagatggctcatccctgctgctggccgacactctgcagacgcactccagcctctttctggaggagctggagatgctggtgccctcaacacccacctctactagcggtgccttctggaagggcagtgagttggccactgaccccccggcccagccagccgcccccagcaccaccagtgaggtggttaagatcctggagcgctggtgggggaccaagcggatcgactactcgctgtactgccccgaggcgctcaccgcctttcccaccgtcacgctgccccacctcttccacgccagctactgggagtccgccgacgtggtggcgttcatcctgcgccaggtgatcgagaaggagcggccacagctggcggaatgcgaggagccgtccatctacagcccggccttccccagggagaagtggcagcgaaaacgcacgcaggtcaagatccggaaccactttggcaccgaagtcaccaatagctcgggccgcctcaccttcccagttcccccagaacgcgcgctgggcattggtgtctaccccgtgcgcatggtggtcaggggcgaccacacctatgccgaatgctgcctgactgtggtggcccgcggcacggaggctgtggtcttcagcatcgacggctccttcaccgccagcgtctccatcatgggcagcgaccccaaggtgcgagctggcgccgtggacgtggtcaggcactggcaggactccggctacctgatcgtgtatgtcacaggccggccggatatgcagaagcaccgcgtggtggcatggctgtcgcagcacaacttcccccacggcgtcgtctccttctgcgacggcctcacccacgacccactacgccagaaggcaatgtttctgcagagcctggtgcaggaggtagaactgaacatcgtggccggttatgggtctcccaaagatgtggctgtatacgcggcgctggggctgtccccgagccagacctacatcgtgggccgtgccgtgcggaagctacaggcgcagtgccagttcctgtcagacggctatgtggcccacctgggccagctggaagcgggctcgcactcgcatgcctcctcgggacccccgagagctgccttgggcaagagcagctatggtgtggctgcccccgtggacttcctgcgcaaacagagccagctgcttcgctcgaggggccccagccaggcggagcgtgagggcccgggaacaccacccaccaccctggcacggggcaaagcacggagcatcagcctgaagctggacagcgaggagtgaggcccacaccagcctggacctgggttatttattgacacacccaaggggcccgaggggctgcgtgtgggaggctggggacccagacttttggccccagcgctggcccccccagccccacaccctatatctccgtgtgctcctcggtgttacttccctttcatatgaggggacccagcgccggggggagggaggagggcgtgggcatgggcgcagaggcttttccagtgtgtataaatccatgaaaataaacgccacctgcacccca

SEQ ID NO: 39314 - DNA, 2263 bp, Homo sapiens
ggcgtcggggagggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccagagcctggagccgaggcagctaaaggcattgaggatggggcccaagcacccagggactcagagggcctggatggagccggggagctgggggctgaggcatgcgcagtccacgccctcttccttatcctgcacagcggcaacatcctggactcaggccctggagacgccaactccaagcaggcggatgtgcagacgctgagctccgccttcgaggccgtcacccgcatccacttccctgaggccttgggccacgtggcgctgcgactggtgccctgtccacccatctgcgccgccgcctatgcccttgtctccaacctgagcccttacagccacgatggggacagcctgtctcgctcccaagaccacattccactggctgccctgccactgctggccacctcatcctcccgctaccagggcgccgtggccaccgtcattgcccgcaccaaccaggcctactcagccttcctgcgctcacctgagggtgccggcttctgtgggcaggtcgcactgattggagatggtgttggtggcatcctgggctttgatgcactctgccacagtgctaacgcgggcaccgggagtcggggcagcagccgccgtgggagcatgaacaatgagctgctctctccggagtttggcccagtgcgggaccccctggcagatggtgtggaaggcctgggtcggggcagcccagaaccctcggccttgcctccccagcgcatccccagcgacatggccagtcctgagcccgagggctctcagaacagggcagtttcacttcacacctgctgctctcaagggacacagtctgttctgcctgaaatagactcccaggcacatgtgtagaatccccc

SEQ ID NO: 39315 - DNA, 1499 bp, Homo sapiens
ggcgtcggggagggactgcaggggcgccggcgggcggatcgagaggaaggtcggggccatgggccggcactgcgcctcgggagggtccggccaccgctggaacccgaggccggggctgggggcgctccgggctccgacccacgggccggccggccctgcccgggctgggtgaggggcgcccgcctcaagctagaggaggagcggaggccgcgcgcggcccgccgagcgccttcaggatgctcatcaaggaataccacattctgctgcccatgagcctggacgagtaccaggtggcccagctctacatgatccagaaaaagagccgggaggagtctagtggtgagggcagcggcgtggagatcctggccaaccggccctacacggatgggcccgggggcagcgggcaatacacacacaaggtgtaccacgtgggctcccacatcccaggctggttccgggcactgctgcccaaggctgccctgcaggtagaagaggaatcctggaatgcctacccctacacccgaacccggtacacctgccctttcgtggagaaattctccattgaaattgagacctattacctgcctgatggggggcagcagccaaacgtcttcaacctgagcggggccgagaggagacagcgcatcctggacaccatcgacatcgtgcgggatgcagtggccccaggcgagtacaaagcagaagaggacccccggctttatcactcggtcaagacgggccgagggccactgtctgatgactgggcacggacggcggcacagacggggccccttatgtgtgcctataagctgtgcaaggttgagttccgctactggggcatgcaagccaagatcgagcagttcatccatgatgtaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggggctgtgtctccccagagcttgtctgagtggcgcatgcagaacattgcccgagactctgagaacagctccgaggaagagttctttgatgcccacgaaggcttctcggacagtgaggaggtcttccccaaggagatgaccaagtggaactccaatgacttcattgatgcctttgcctccccagtggaggcagagggaacgccaggtaaagataccgcctaggacaccggcccccagcacccgtgtacagcaggtcatgagtttaatggcatcttaagatgagaggcaatctgaaga

SEQ ID NO: 39316 - DNA, 398 bp, Homo sapiens
acccatcacttctctgggggtgacatcaaaaagggctgttctattccccctgtcaagtccccctgaaggccttgtccccaactcttcttgggttgggttagctatagttaatacttccacaatatctgatgcatatctttgtcttggaacttctatatagtttatatttacccatttaatagccttttcttcctaaaaatgtaatatgtaggttgatgtggaatattagcaaattatagataaccaaaactttttaaaaaaatggctagtattggccaggcatggtggctctcacctgtaatcccagcactttgggaggccaaggcgggccgatcatgaggtcaggagatcgagaccatattggccaatatggtgaaactccgtctctactaaaaata

SEQ ID NO: 39317 - DNA, 407 bp, Homo sapiens
gttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaa

SEQ ID NO: 39318 - DNA, 156 bp, Homo sapiens
aacagaaaaaaaagtgttatttaagtgaatgctgaatttcatgccataaaggcattaatgtttaagcttacttcatatttttataaagaaaatatcagaaatataagaactacagatcaagaagataaagattgataacttaatagaaaaaaaaag

SEQ ID NO: 39319 - DNA, 315 bp, Homo sapiens
aatggctcttctttcaaggttctaaagtgtaagaacagatcactcaccaggtaactgctggactcactcactcaagcagtctcataatacgcatgtgatcccttaggcgtacatagttcatctattttcttcttcccacaattcttcaagtccattataatcttctatcttgcctgtggtctaattagagtaatacatctccctacttgcccttaattcacaaattaccccattttacagggggagacaccaaggccaagagaaacacaaatgccctgccatacagtaaacccatctcacatctggtatcagaac

SEQ ID NO: 39320 - DNA, 280 bp, Homo sapiens
tgaattgttctctgtttaggacattagcctgggtatagaatttaacaataaaaataacagtaatagtaataatagtagctagcattccttcagcacttcctatgtgctagatactgtgctaagcacttggcaacctcctaatttaatactcatgacaaacctgggagatacgtactattactatcaccattttacagacaagaagagagagaagctgagaggattttaaaaacttggcccaagataattatggggcaaagagaaaatataatagctataa

SEQ ID NO: 39321 - DNA, 142 bp, Homo sapiens
gactgagaaactgtcacaaaccagaggagactggggagagatgacaactaaatgcattgtgctaccttgggtaaaatcccggactagaaagaggacattaatgaaaaaacagatgaaaaccaaataaagcctggaattcagt

SEQ ID NO: 39322 - DNA, 536 bp, Homo sapiens
gtgtgggcctttcctatatccccgtcttttataagagcatgtcatttagttgagaccttctgcattacttctgaaggggtacaaaagacatttctgatgattttctcatctcgtgtcatttaaatggtgctcagaaagtttggataggactggaactctagggctcaagccccaggctctgtccctatctaagcaatagggcagctgtcctgccagttgggttcttgcttctttgtgaaatgttgagcagaagctccaagtctctctgctgtggcttgtgtggcaagaaccatcctgaggttctgtgcagagagccagcctcacctttgagctcagtggcctctggcacagggaaattacagctgggcagtgtcctttgccttctctggcactgctagtgcaggaggcagtgttagctgctacaggaatagcatggagcgggcctgcaggccagaggggctgagacaagccagtgttcccaccagacctagaacgttcaccagaaagcaggcctgcagtgacacagctgcagaagt

SEQ ID NO: 39323 - DNA, 301 bp, Homo sapiens
gcagtagagcgaggaccagcttagcctagggagcccgactgggtctcgtcctcttgcacccatgttcagaccagagctgccagcctcacctttgagctcagtggcctctggcacagggaaattacagctgggcagtgtcctttgccttctctggcactgctagtgcaggaggcagtgttagctgctacaggaatagcatggagcgggcctgcaggccagaggggctgagacaagccagtgttcccaccagacctagaacgttcaccagaaagcaggcctgcagtgacacagctgcagaagt

SEQ ID NO: 39324 - DNA, 499 bp, Homo sapiens
ggtttttattagcaattatttgcctttcccctgtaatgaaaatgatcacaataaaattcactttgtgtcatactgaaacagtattcttctgctgttgacatttgtttggttaagccttactgtatctccactatatttgagatgatggtattagtatacattgctagaagagtttcagccagtctagacagttaaagagtgtgtctttcttccttgacagatattatctaagaacctcctcaattcgtaacagcacacatagagatttatggctttagctgactaaatgaatgttgcttcagcctgtgatttgtggtctagcgaacaaccgcagagcatgtcctttacaattgattgacctttgcatagcttattttgggccttactaagaacatcttaaactggaaatgatcctattaagaaagtgtcctgtgctaacttcagaagaagttattcttccttaaagacttaattttctaactgcattttgagtctcacc

SEQ ID NO: 39325 - DNA, 686 bp, Homo sapiens
gtggattcacgaacctcgagctggcagtgagttatgggcaagccaggcctcagccactcacagggcctcagttttcccatctgcacagggagaagggaaggttcagtggccctgtgagctttgctagcaggtggtgatggggtgggtcatctgaatctgagtcaggtggaatcttccccaacctgggctttggtttcattttgttgttatcctttaaccttacctgctttccaagagagattttatgttttcttggttttttttttttggtttgtttgtttggtttttaggggtagggtcttgtagaatgcaatggtgcaattatagctcactgcagcctccaacttctgggttcaagtgatcctcccaccttgttttttgttttttgttttgtcttgtttttttggtagagacagggttttgctgtgttccccaggctgctgtcaaactcctgggctcacccatctcggcctcctaaagcgctgggattacaggcacgagccactatacctggccaagattttatattttctaattgcttcacatactgaatggaaaatagcatgacagttataacagaagtaaagaaagtcacatgagagtccaccacctaaaatataacttcctttttctttgttctggcctggtttgggccgtatgtatttgttattgtatctcttaaaaaa

SEQ ID NO: 39326 - DNA, 296 bp, Homo sapiens
tagatgattcaataaatgatcgactgtgtactcatttggggataaaatgtggagatcttctcaagaaaattacaaattgatttaaaaagaatcatgtaattcttggtgaaacaccgtctctactaaatatacaaaaaaaaattagccaggcgtggtggcgggcgcttgtagtcccagctacttgggaggctgaggcaggagaatcgcttgaacccaggaggcggaggttgtagtgagccaagatcgttccactgcactccagcctgggcgacagagcgagactccatctcaaaaaa

SEQ ID NO: 39327 - DNA, 497 bp, Homo sapiens
catgacagccatgagagctctgagggggtgtgtttctccaggcatgtggcctacccacccacaccaatgggagaagctgctgctgcactaagcagtggatcatctgattacttctactggcttcggtctccccctcaaatacacagccatccaggccccaaaaaccctagggggaagggtcccttggctcttactcaataatccacaaaatctcattgcaggcggagtccttaataatgccatctgatgaataatggttctgtattctggctgcacattggaattatctgtgtaactttaaaaactaaacatttctcacatattatatgattctattcagcagatcagcagttgccattgcctatgagggaagctacagggaatgactgctaatgggtgcagagtttctttttgagatgttgaaaatgttctggaatgaaacagtgatgttggctgtacaaccttatgaataaaaaaattgaattgtatactttaaa

SEQ ID NO: 39328 - DNA, 272 bp, Homo sapiens
acaccccatctctactaaaaatacaaaaattagccaggcgtggtggtggacacctgtaaggtgaggcaggagaatcgcttgaacccaggaggcagaggttgcagtggatcgcgccactgcatactagcctgggcgacagagcaagactctgtctcaaaagaaagaaaatcttcccttttttgcatacagttgttcacatttcaagaaacatatatagtcacgtaaccaaaaccacaatcaagatgcagaatggttccatcgccaaaaaaaaa

SEQ ID NO: 39329 - DNA, 574 bp, Homo sapiens
tcaattaggtagataagacatgaacatgcataactgtaatgcaaggtcagaactactaagggacatacaaataaaaatactgtagtgtttcagaggaaatacaattagagattgagaggggagggtattaatgtaagagaacggtaggctaaaatcacataaatagaaaaatgtgaagagtgtgtaggaaagaacaagcaattcagtgtagttatagtgtgggcattatgaaaggaaatggtgggcagttggagaatgacaaatgtaacttgaatcatgtgggttaacatttgtatgaattatgtgggtctacattatggaacagcatttttttcaactcaaataattattggtgagtgttactaaaataattatttgtgtgtttaccccccttgtggtatataggactcttggatgcaggtgttggaaatatgatttcagtaaccttaagcaaaaaaaccaagttaatgtgtgtaataattggcaagtctggttagggcttaggctgagctggatctgggagctcagataatgtctctccatctttgaatccagtggtctctgttcaacagat

SEQ ID NO: 39330 - DNA, 396 bp, Homo sapiens
caccaactattatccctgagatgaccttggctgtggaacccagattctgttcagggccgagagcgccacctggtgattccagtttgtaaacggaggctggtgggacctcaaccccagctggtatccaggctcttgacaccatctggagaaggaattcaagagtgtgtcagaaaatgatgaaagtacaaagatttattgcaaagcgaaaaatacacactcaagaaaggggagtatgggtggactcaagacagagtccgatgggacttggggtttctaccttttgggtttcttttttttttttttttgatatggagtctcgcacttccagcctgggctacgaaggaagactctgtctcaaaataaaataaaataaaaataaagctgctatcaaaaaaa

SEQ ID NO: 39331 - DNA, 277 bp, Homo sapiens
tccagatttttgcttagctgggtagtttctaaactcaacagactctccaggtaggtagttcctgcacggggctttcctgtcactggatctatgacttttccaactttgaaaatgatcttggcctgttcatgtttcacatgcttcgttcatgggacaggtaaagctctgagaagcacgatatccccagctgtgcactgccgaaggccatcgtgaacaaaggaggttttccacttattataatactttaataaatagggatccagaacaagcccggtca

SEQ ID NO: 39332 - DNA, 462 bp, Homo sapiens
  misc_feature (461)..(462): n is a, c, g, or t
tctcaaaccgacagtgtgctctgtgacccaaggcaagtcttggagcctttcaaggcctcaatttcttctgtaaccttgtggtttcacaattgtcaaccttttgttctgccgaccattgtcgtcatagtcttacttgcagagggcatagtgctgatgggacaagtgacatgggtatgagccccatgtaaactaaaacataattacctttcctttaggtgttggctacagttatcccaaacttggacttgaggtcttgtatatgcatgccattggtcacataccatcagaatagaattctcaaaaactctttagtaaataagataaacatcctacttataacagctcattatggattttatttttattgtctggctctttcagaccccagcaactgcaattctgacttaataatcaattgtttctaatcattaaaaatgtatatagaaaaactgaaaaaaaann

SEQ ID NO: 39333 - DNA, 1027 bp, Homo sapiens
gatcatgaaggtggggtgaattattagagtggagaagattcacaggggaggtggcttttgagccaggcctttttaataaagcttatcgagcatcattcaagacttccaatcagtggagtgacacaatcatgtcattatgaaataaacgtgacaaatgaactggagaggaaaggggcaaaaggaaaggatctaagatgtagctatttaaacaaaacaagagatgacaaggctaatggtagtgggaaacaaaagaaactaatccatgaaccaatattacaaatgaatggaactgccatgacttgacaaatgattggatgtggtgcatatgtgggaagagagaatcaaagacaatttgaggtctttagccctgatgaatagaaggatggtgaagcacttaaatgagataaggtatacagtaaggaacagcaaattttcaatgggagtgggggaatagaatgagctcagtcctagacatgttgagactatgtgtccatggtccacctatagaagaaaaataaggttctagagcttaggagagtatgcaaagctggaactgctatagtttagggaactgagggatccttacagccaacagtagaagatgtaattgtccagatatgagcaagagtgtacaggcagactcctggggagtgcctacattccagggtagatacaggaatcgcaggtggggacccagacttacatggaactagagcagtcaggaaagacatgttcagtgtagtattaaactccatacagaggagaaagtttcaagaaggaggagggtcaaaatgcccctcaaaactgcaggaagtttaaatgcagtgagtgatgagaagaaactattggattagcaattagtaggaacttgatgttccatagagtaggcattttaagggaatgaagggaacagaaataataaaaaaataaaagagtaaagaggataacttgagtttgaaattatacacgtacacatgtgcacacacacgcacacacacacagagttgccatgtccttcgtcttcacc

SEQ ID NO: 39334 - DNA, 381 bp, Homo sapiens
actgagagctcacaaaggagctggaatgagcacaggcagaagttctgaaattatagttcggttgccataatgagtgggctccattacacccagaaaaccatgtcccctttttcagtttttatctctgtgaagtagacacattctgacctgtgataaaatgcaatcagcggccaggcacagtggctcacacctgtaatcccagcactttgggaggctgaggcgggcagatcacgacgtcaggagttcaagaccagcctgaccaacatggtgaaaccccacctctactaaaattacaaaaattatccgggcatggtggcacatgcctgtagtcccagttactcaggaggcttgaggcaggagaatcgcttgaacccgggaggc

SEQ ID NO: 39335 - DNA, 328 bp, Homo sapiens
ggttaaaagattactattgaagggatctttaaaaaaacaattaagaagggctgggtgtggtggctcacgcctgtaatcccagcactttgggaggccgaggcgggtggatcacgaggtgaggagatcaagaccatcctagctaacacggtgaaaccccatctctactaaaaatataaaaaattagctgggcgtgttggtgggcacctgtagtcccagctactcaggaggctgaggcaggagaatagcgtgaacccgggaggcggagcttgcagtgagctgagatggcgccactacactccagcctgggtgacaaagcgagactccgtct

SEQ ID NO: 39336 - DNA, 986 bp, Homo sapiens
ccagtacactcttctgtgtttccgtattatcttgttggtatttctatcccagctgtagagtttttaataattctattataaataatggaatcaggccagcacagtggctcacgtcacataatcccactctccttaagagctttttttgtcactgcatatcaactcagttgacaaggactggcccccaaaagaagctgcatactcacttggcagtcactccccattctccctagctcctggcaacaacttaacctgtctctgtggatttgcctattctggacatttcatataaattgaatcataatttatgtagtcttttgtgactggcttcttttacttaggatgtttttaaggttcttactgttgtaggatgtatcaggagtttgtttttatgatgaatgttccatcttatggacgtaccacatttgtccattcattagttgacagacatttgaattgcttccacttcctggcttctatgaataatgctgccataaacatttgtgataagtttttgagtgaatatgtgtttttgtttctcttgggcacatacagggaatggaattgttgggtgctgtgataaccttttgaggaactgccagacttacggaaagcagttgcactattttgcattcccaccaagcaatatgagggttccagtttccctccatcctcattaacactttattatctttttgattataggcatcctagtgtcaagtggcatcttattgtggttttgatttgcatttccatgatggttaacgatgttaagcatcttttcatgtgctcgttggccatctatatatctctggagaaatgtcttttgaaatactttgcccatttaaaaatgttatttgttgtttagccacccctccttaaaaaataaataatataataatccatcatcccttgccttttcaggaccatccgggaggcaaatctttcttagtctgaacttcatacatccctttagttcccagcct

SEQ ID NO: 39337 - DNA, 3380 bp, Homo sapiens
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39338 - DNA, 2441 bp, Homo sapiens
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctggttccagtggcagatggggcactggccagaggggttaggaggatttggactctccttgggagtcgctgtgatacggccttcaattatagttgtctttccttcttggatttccaccacttccctgaaaccacgagctggaagctgagaccagctggtcactgctgggcctgctaggagcccacacggaagctgcccacagccagacaccagagcctcaaaggccgccatcttgaaaaaccaaccctgacctccacaatgattgattttcaaatgttgaaccagctttgcagaactataataaacccaagtgtgataccctgtctcaagtattgcggtgatcaaataggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39339 - DNA, 840 bp, Homo sapiens
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggttctggaactgggaagtccaagatcagggctcctgcccctggacctgaacctggatctttggctttgatgttggaccttgtgtgtggatatgaactttgaacctgcaccttggaactaaacctctgacttggatttgttctgcattttggaactcaccttagacctgaaccttggtcatgaaatggatctgaatcattcttgggtcttggacatgggacttggacctccatgtgtatcttggacttaggaccatgatctggaccttgtaaaattgacttggactttggacttggaccttggactagaatttgtccctggctgtggacctcgtctttggatctggatctggacctggtcttggatgttggacctaagatgcaggccttgatttgatttggaacatggacttgggtccttgcacattggcccaacacccgcgtctttggaactgcatcttggaccttggatctgaaatttaaacaggggaggtgaccttcatttcttgtatttgactttataactgggaaatccaatctctacttgt

SEQ ID NO: 39340 - DNA, 3101 bp, Homo sapiens
atagaagcccagagagaggtaggtgtaggaggcctgcagctctgattgccactccaacctgggcaataagagctactccagcctgggcaatatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39341 - DNA, 3326 bp, Homo sapiens
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39342 - DNA, 1999 bp, Homo sapiens
tcgaatggaacccgttcgtacgagaatcgctgtcctctccttgctcgagatccattgtgctctaaagcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39343 - DNA, 1311 bp, Homo sapiens
ctaatggataatgagtgttatcttactgtggttttgatttgcatttacctaattactaatgatatgaagcatcttttcacgtgcttactggccattcgtgtattttctttggagaatgtctattcaatctctttgcccatttgtgaatcacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39344 - DNA, 907 bp, Homo sapiens
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggtgctctcctatcaaatctagaatgtgcaaagattgtggacagcaactgaggtgctaccagtgataccaaaaagtctgctggataaacaccatctctattctaatattatggagagatcaggatctccgtgtgcccaaatcaaacctgttaatacactcagctgtcctcaggtggtaacactgaggtcaacacacaactccaaacatcaggaaacaagtcataaccattttgctctgaaacaggtgcctgaccacaacggtgttgactcacttttatttactaaattaagacctaatataggtttcattttccaaaaaaaaaagaacacagacagaacaaaaactgtgttgggcgcggccgttgcccttgaaaaaagcattcttagccactctgttggggcgggcggcaatgagtagaactggcaactgcggtgtccaagagactccggccacgaaggtgtgtgtctccccaaaaagcgcggggcccggcgtcgacacaccagtcgctgggcaaacggctataaaggccagagcgatgccaccccgccgggagggacggcaaagacagcgagagacgaagaggagacaaagcagcacagcaggcgcagagaat

SEQ ID NO: 39345 - DNA, 3725 bp, Homo sapiens
cggtgcgcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctggttccagtggcagatggggcactggccagaggggttaggaggatttggactctccttgggagtcgctgtgatacggccttcaattatagttgtctttccttcttggatttccaccacttccctgaaaccacgagctggaagctgagaccagctggtcactgctgggcctgctaggagcccacacggaagctgcccacagccagacaccagagcctcaaaggccgccatcttgaaaaaccaaccctgacctccacaatgattgattttcaaatgttgaaccagctttgcagaactataataaacccaagtgtgataccctgtctcaagtattgcggtgatcaaataggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39346 - DNA, 2705 bp, Homo sapiens
tcatccccttcgtgactgcagaaacttaggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaatgtg

SEQ ID NO: 39347 - DNA, 444 bp, Homo sapiens
gatgtacatgagattgccaaatattttctattctagttgtgctgcaagacattgaacaaaatgttaatgaataacattataaatcaaggaactaagtacataggcttgagtaagcaaccctaaggatgtgtagtaagattccaagtagagctgctacaggtgagatacttaatggaatgtgaaacttcactgttggactgttaaccgaaaaggtttgctggctgtgcccctccagtgctaactgtgacatgtgatatttaatacaggtggagaaaaactagtcttagaaatgggatttttgtgaaaatagattccattttgattctggggctggaaaaacacttcataaacaaagtaatagtctccaaggaaatgaataataaggtttaaaatggtaacagcagttattactacttttatattaagaaaaacagtagaaaagga

SEQ ID NO: 39348 - DNA, 112 bp, Homo sapiens
tctgttcagcagacccatggagtgaactcaataaatatggccaacacatgagagccactggagacatggtggagcaggagtcctgtgtgagttcacaaattattcatgacag

SEQ ID NO: 39349 - DNA, 252 bp, Homo sapiens
ttgtaaggaattgaaatatgtaatgccacacataaacatttctcttaaaagttacaatgaaaggtggagcacagtagctcatgcctataattccaacaatttgggaggctgaggtgggaggatcacttgagtccaggagtttgagaccagcctcagctatgcagcaagaccttatctctatgtacacacacaaaataagctgggcatggtggtgcatgcctgtagtcccagctatttgggaggctgaggtgg

SEQ ID NO: 39350 - DNA, 383 bp, Homo sapiens
aatttaagcttttttggtgacttgaggctattattacaattaccctttctattattttgtggaagtaaaataagggtattggatataagctttactcatctcagttccaaacgggagacttccttcttgaataattcctgatatatctaatttctggttgtaatgaatttattacattaatattacacttatacgttccttgcagatactccagaggtagagaccagatgtccagtacctttagggtattggaatatgaattagggatgcctgcattgtttttttttttttaatcagcagaatgatactgttattgttggctttatggccgcggctgctttcagccctgaggatatataagaatgaaaaaaaaaaaacctagc

SEQ ID NO: 39351 - DNA, 119 bp, Homo sapiens
gtttatttcaaaatataaataactaaattggtagctcatttattatgtgacttgaaaatacaaaagtacatttaatagagttagtgtgctcaaatacatttatttttgataatagaata

SEQ ID NO: 39352 - DNA, 689 bp, Homo sapiens
aatagaagtagtagtagtagtagtagtagtagtagtagtagtagtggtcactgctatatggtgagcacttactacaccagcagaaggcctcatcacagccctgaaagttatccccgttttacagatgaggacgagaagtctcagagaggtagaaatttacctgctgtggcacagctgctcagcaagtggtcagggccaagggctgcaagtgaattctttttaactatctttctgtctgttccttagcttactttcaggtttagattgactttgctttgttgaaaatactaatggctcacacacataaaggtcagacatgatggagccctttcctcgttttagaatttggtccttgttacagccctgtgaagatagtgacataattatcctatggtattagtgaaactgattttctttaagtgtgcccctgtcattacttgtcacttgccttttgaattaaaataatgctacaagaactgctttttaatctatatattccatcattcaaattcaagtgtcttaagccttttacataccaaaataggtatatttgaatacaggagaagtcaaagaaaggcaatctggaccagaattctgatttttctgggtagtaaagtttccttcagaatgctggtggccagcataggattgccagttctttattttgccaagtaagaacattaaaaaaa

SEQ ID NO: 39353 - DNA, 479 bp, Homo sapiens
aatagaagtagtagtagtagtagtagtagtagtagtagtagtagtggtcactgctatatggtgagcacttactacaccagcagaaggcctcatcacagccctgaaagttatccccgttttacagatgaggacgagaagtctcagagaggtagaaatttacctgctgtggcacagctgctcagcaagtggtcagggccaagggctgcaagtgaattctttttaactatctttctgtctgttccttagcttactttcaggtttagattgactttgctttgttgaaaatactaatggctcacacacataaaggtcagacatgatggagccctttcctcgttttagaatttggtccttgttacagccctgtgaagatagtgacataattatcctatggtattagtgaaactgattttctttaagtgtgcccctgtcattacttgtcacttgccttttgaattaaaataatgctacaagaactg

SEQ ID NO: 39354 - DNA, 388 bp, Homo sapiens
ttcaaccaagatgccagcagtctgactcatcattgtttctgaactatcagtctaaatgtcaccacaatgaaaataatttgatgtccagtataatggtgcatgcctataatcccagctacttaggaggctgagataagaagatcacctgagcctaagagttctggcctgtagtgtgctatgccagtcaggtgtctacactaagctcgacatcaatataattacctcccggaagtagggggaccaccaggttacctaaggaggggtgaactggcccaggttggaaacagaggtcaaaactcctgtgctgatcactagtgggatcacgcctgtgagcaaccactgcactccagcctggggcaacacagcaagaccccatcttgggaaaaaa

SEQ ID NO: 39355 - DNA, 478 bp, Homo sapiens
cagtctggaagcatcactctcaaaaagccattgtagagaatccaagccgagtttaagagtgctgtggaaatacactgctgctactgctgtttctattactgtttgatgctgggactcttatgctccaaccacgttttcacccagctgagtcgccttcgtatcacgcctctccactcagagaggaagaaaggaccgtgtgagagaagaagggaacagcctttcatccataggagaagttcgtctatgacaaagccactagctccatgtggccgctgagcactcaaaatgtggccagtctgaattgagatatgttgttagtataaagtccacatcggctttttgagcactttgtatgagaaaaaagaataccaaatatctccttaataattgttacattgattatatgttgaactgataacattatggatatattggattaaataaaatatattattaaaatcaaataaaaaataaaatc

SEQ ID NO: 39356 - DNA, 451 bp, Homo sapiens
tgtcacaccctgcaggttttgatagactagaaaaatgacaagactccaagtccttgaagaggaggaaaagtgtgaagaaaacaaaaaagggagatttatgtctgcttcaccattttgcccaagacttgacctgtcatacactgaagctcagagaggaagaaaggaccgtgtgagagaagaagggaacagcctttcatccataggagaagttcgtctatgacaaagccactagctccatgtggccgctgagcactcaaaatgtggccagtctgaattgagatatgttgttagtataaagtccacatcggctttttgagcactttgtatgagaaaaaagaataccaaatatctccttaataattgttacattgattatatgttgaactgataacattatggatatattggattaaataaaatatattattaaaatcaaataaaaaataaaatc

SEQ ID NO: 39357 - DNA, 416 bp, Homo sapiens
aagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtct

SEQ ID NO: 39358 - DNA, 613 bp, Homo sapiens
actaaaactaagacattggttggaactatatccattccagggtctatagattcacaagagcaacaagcccagaattcccttccttggctgtcctaggatagctgcgtatcaggcccacaaaagggtcgtaatgcagaaaatggggctgctcagtgccccaacagtctctggagccacagccagtatgccatccttgtttgacacatagtgcttctgttattttcatttaactgaaagcaacaaatctccttttttccctctaaaaataagagtttatgagggtttatatgatttcttttctagcctgcatttcatgtgcatagatcaaagttacttgtttgataagaagtgcttaacataggaaactattttggtatataggtctttagggaattttgactttgggcaagaaagaacacttggagtcgaaatgagaggacctggattctagttttttgtatcaagctggaaaggcacctaacctctcaagacatatttttctgaagtaaacttattggaataagtgatctgaagataactctcatctgcctcctttcaatgaataactttgctcccaaatctaatgagcttgaagctttgaaagaaactcctt

SEQ ID NO: 39359 - DNA, 1296 bp, Homo sapiens
atgtaaatgctatgtaaatagttgttatgctgtattgtctagggaattatgacaagaaaaaacatctgtatatgtttgtacagacagttttttccccaactttttttttttttttttgatttaaggttaattgaatccatggaggcagaacccatggatacagagggccgactgtactgtcaaatatttttagcacctccttcactaagatagagcttaaaatgagcaataaacacaacggtgaatattagaatactatatagagcatttatagaactaaaatgtttcaaccttcaattgaacaactattttcttgttattttggattttagtatttcagagtttaatttatgtaatgtctcctatgacttctttaggctatccttgccgtaagctctatctttggcttacatatttttaacatccaaccttattagagctggcttaagcaaatatattttcatgtatattatttaatagtgttctttgaaaactgggttaatatttgctttaaaacctacagattaagacaagtggaaagatatccataccaacttgatacaaaattttggaagaaaataggtttctacaacactaaagtgatgtcctaactaattactaatttggaactcttggggctgtttgaaaaaaaactatgaggagaatatttcaactttatatgtgaggcagtttatgagttctcacagtttcggtgtaatttacttaatagcttgctttcttccagccatccttccttgctttctttttaaacaacttcttttttctacttcaaaaaaggtacataagctttatagaaaacttagaaaatacaggtaagcaaaaataagaaaattaaaactacctataaatccaacatgcagagataaccactgttattaatctgttaatgactatatttttctaatatttttaagatttttatttctttttaaaagtaggatcatagtaaacatactgttttattagcctgctgtttttcactttacattatatcttggaaatacctccttgccatcagttactttcacgtaaccttttgatggttctcaccattgattgtaaatatttctttttatgtgtgagacttttgtggctttctcattttcgctgggggaatgtaacaagaagctcagttttcttttcaaaaataaaaatggcactgagtgcggtggctaatgcctgtaatcccagcactttgggaagccaaagtgggaggatcgcttgagcccaggagtttgagaccagcctgggcaacatagtgagacccgtctctgc

SEQ ID NO: 39360 - DNA, 363 bp, Homo sapiens
ctcatttgagcccaataatccatcaaaaataaaactgttgttatttcattttttagatgaggaaattgaagtccagagaataaaaatagtcaacttccagactaaattccaaattcagtgttgatcctttcacagcgagggaaaatgggtctgtttctctccctgtctctatataaccacaaatccctccctaggtgatcctccctggggatggagtcctagaaagccaaagacagtcttctaaagagccaacagcctaaattggcatttaatccagtcaacatctagtacttttagatctagtttctcctttgcaaggaatacaggcgatagaggaaggttagaggacactagcagtcacat

SEQ ID NO: 39361 - DNA, 451 bp, Homo sapiens
tcagaattatcaaattagaccgtgagaaggctccatatggaatcctgttaatatagtccctcactgaatcaccttaacaaaatttcatctgaatatttccctcatagctttaatcaaagttactttagtaaatatccatatggaacttacttctacatttttgcacaaatattaaaaacattgtccttcccgtcaacatatcactcatagttccccatattattaaaaaaactttattatgaaaatttagctacaatttatttcgggaaaagcgattctccttaggaattatcttttctgataatcaaaactacaatcgattatgatttctttttagcctgggcgacagagtgacagaccctgtctcaaaaaaacaaacaaaaacaaacaaacaaaaagatttgccaagaactacagaactctcgagagaaatggagagcttaaaaaaaaa

SEQ ID NO: 39362 - DNA, 363 bp, Homo sapiens
ctcatttgagcccaataatccatcaaaaataaaactgttgttatttcattttttagatgaggaaattgaagtccagagaataaaaatagtcaacttccagactaaattccaaattcagtgttgatcctttcacagcgagggtgatcctccctggggatggagtcctagaaagccaaagacagtcttctaaagagccaacagcctaaattggcatttaatccagtcaacatctagaaaatggattactacttcccagattatgttgtactttaattaaagctcgcaaattacttttagatctagtttctcctttgcaaggaatacaggcgatagaggaaggttagaggacactagcagtcacat

SEQ ID NO: 39363 - DNA, 417 bp, Homo sapiens
ctcatttgagcccaataatccatcaaaaataaaactgttgttatttcattttttagatgaggaaattgaagtccagagaataaaaatagtcaacttccagactaaattccaaattcagtgttgatcctttcacagcgagggaaaatgggtctgtttctctccctgtctctatataaccacaaatccctccctaggtgatcctccctggggatggagtcctagaaagccaaagacagtcttctaaagagccaacagcctaaattggcatttaatccagtcaacatctagaaaatggattactacttcccagattatgttgtactttaattaaagctcgcaaattacttttagatctagtttctcctttgcaaggaatacaggcgatagaggaaggttagaggacactagcagtcacat

SEQ ID NO: 39364 - DNA, 802 bp, Homo sapiens
gtttacatagaaagaattttctagggctgggcctggtggctcatgcgtgtaatcccagcacgttgatgaagctgaggcaggcagattgcttgagcccaggagttcaagagctgcatgtgtaacatggcaaacccttgtctctacaaaaaaacacaaaaattagccaggcatggtggcgcacacctgtagtcccagctactcggggggctggggcaggaggatcacctgagcccaggaggttgaagctgcagtgagatgtgactgtgacgctgcactccagcctgggcgacagagtgacagaccctgtctcaaaaaaacaaacaaaaacaaacaaacaaaaagatttgccaagaactacagaactctcgagagaaatggagagcttaaaaaaaaaattctaatctgttatctcatttgagcccaataatccatcaaaaataaaactgttgttatttcattttttagatgaggaaattgaagtccagagaataaaaatagtcaacttccagactaaattccaaattcagtgttgatcctttcacagcgagggaaaatgggtctgtttctctccctgtctctatataaccacaaatccctccctaggtgatcctccctggggatggagtcctagaaagccaaagacagtcttctaaagagccaacagcctaaattggcatttaatccagtcaacatctagaaaatggattactacttcccagattatgttgtactttaattaaagctcgcaaattacttttagatctagtttctcctttgcaaggaatacaggcgatagaggaag

SEQ ID NO: 39365 - DNA, 827 bp, Homo sapiens
atctctttccttgctgaactttccggtcattctcagctccaccctctaactgcagtatcaactgaatctcatgaaatgttttggcgaagcacttctttccaaggatgtcaaaaatcttctgagttaccaggaggaagtggttgcctgtcagggcagagtcttactcttgcatatattttagtgatatatactatatataaactcttggattacaatatggatgagttctacttttattctagtttgttcttcaggctacttattctgcttaatttcggtttggaattaaatatctcagtctgtgcaacctgttttttagtttcttgatttagaagaattattaatcccataagcaactgtcaatagaatgtatctaattcctgtgaatcttagtttcttcatgtctaaaatgggggatttttggcatagattcactatgacttcatgaaatttagctcagagtttgtatctgatatattcactattgaatccttggaatctgtctatatggtgcttggaacaaagtgggctgttaataaattattaaataaatgcaagaatttacttgaaattgttactttaacaatattagtaacattataagggagtggtatttgttttgataaagtttttttttgtagtagaagattttaaactttgtgttcaggcatattcttatttgaaatataaaattaaaatttgtgtgctgggcgtggtggctgatgcctgtaaacccagcactttgggaggctgaggcaagaggatcgcttgagctcaggagtttgagaccagcctgggcaaaatagcaagacccagtctcattaaat

SEQ ID NO: 39366 - DNA, 753 bp, Homo sapiens
tatcacagagcagctggacatgggggagcttgcagcgtcagcaaatcatggacactcaccctgctacccagagagaaaagggacccctggagacttgagcaaaagaaaaatgctggtacatttttaccccaggaggcacagccaccccagagccacacagcaatggatacttaagaataagactctctgcaggaggatcaaggagtaataaaaagagcagaatatctgcagctgccaagacctcggctctaattctagatttgcagcccatggctgcacaataggcacaagaatgaaccaacgtcaccaccaaggaaagtggcacagctgagctgcacccacgtctgactccaagggaccagctattgacagctattcaccatttggtttctgtgtgtcccagtcctcacgtggaaaatgggcaaatattatctgcttcatcggtattcctgggaacctagaggaagcactagccaatatcattcacttagcataccggagttatctttccattttcttaattcaagaaccttgctctttttgccaattatcttagtagtttttcagtgacctctcagtaaaagcaatgtattttgtagccttgtctttcacagaaatcgccttataaattgtttgatatacaattaaacaaaaactttatttctgcaaaaaaaaaaagcaaacgaatacattataacaaagatatctgaaaacagcgagcgaattaccgaaaattggccttctttggcctca

SEQ ID NO: 39367 - DNA, 653 bp, Homo sapiens
agtgaattgattgaagttgggataatggaattcattcttcccttttcagctgtttctcaaacatctctctggctgtgaacttttttcagagcttgaggttaatgcccaaaccctgtcttgctgtcacctcaaactcagtatatataaaattacattattttccttcctccagtctttcacttttgttaatgctgccatcactgacagtcctcaggcacaaaaccttggtgttatcttgcagtgttcactccccccgatccctagggtgctgtatattcccatttatgtgtttgaggaagttttctggttactgtttcacctctgctttttgcctattgacattttagccagccctcagggccctgcctcagtctttctcttctgagcacgaagctgaatttccatccaagcaccccttttgtacttatgtttatagtttgttttgttttgtttttgagacaagcctggggaacatggtgagacactgtctctacagaaaataagaaaaaaattagctgggtgtggtggcacgcaagcgtgactccagctacttaggaggctgaggtgtgggaggaccgcttgagcccaggaggtcatcgctgcagtgagctgagattgtgcccactgcactccagcctgggcgactgcgcaag

SEQ ID NO: 39368 - DNA, 399 bp, Homo sapiens
gatacaattttgaagaatttcaaagtaatcctggaaacttctaaatatgattgtaggagactctgcttgaatagaggtgatgactattaaataggcatatcaaatgatttgccttgagacaggaaccaaagtatagtgacaggattgattagatggcgaaacaataaaagcaccaggagctaagctacattgatggggtatgtcctgtttgataacagggttttgttcctaactagcattctggttcaaaatccataaggtttagctattttcctatctctttcactccatccccatccactcactgatttcttttgtttctatggacgttattatgtgacccagtttattacatttgactgatatggttttgaataaatgtataaatatacacagaca

SEQ ID NO: 39369 - DNA, 254 bp, Homo sapiens
agttgtaggatattataagattgcatatcagcatagggaatttaatttgtgacaatttagctttatcacccatttaattggttgctttattatttgtaagctatgttaaaagtttttttactgtttcttaggctcagctaagtaaaagaaacataagtgatatttatctatacacctataattatagattagttatgttgaatttatgggccaaaatgtgatctccctcatttccaagctacaagcaccaaatt

SEQ ID NO: 39370 - DNA, 2010 bp, Homo sapiens
  misc_feature (747)..(747): n is a, c, g, or t
ggtctaagtttcctgcatcagcaacagaatctagtaattgttacaaaactcttgaatagctgggagagatgcaaactctaagctgcctgccctcttaaaacttggtcttttgtattttaaacagttgagttttatgtcatttgtctcaaaattagtcttgggtcattatatatttctatctactgatttatacattcaggatcaggtcttgacatttagtacatttaagatggttatcaggttgtagtcatcaagcacctatttctggctgtggccacccagccagacccatagagggtagaaaatttgtagatgactgtcatggccttactgacctctgaacccctatgtaatacttgagtgaaaaggacttggaggcttaaccagatgactagctgacatacctctggaagaaggcaggcatcggagccctcttccagagcatcagagaagatcaaagagctcagatctcccctccagaaagtttcattcaaacactcatgaccatatcaacacttatatgtcaataatatctctttaagaaaatgcgaatgtcattgctgtactcctctgtgttgcctatggtggttcaattgtgtgagtcaaaactccaagcctttgggtcacttgttcactcatgcctctatcaataaaccctgagcacctgggaggcagcctgacagagggaagaacaaggactttggcatcaacgcctcctaggtccaaatcccagacaggcaatttgcnaactacagcttggccaagtaatttaacctctctgatcaaggtgcccacttgtaaaactggaacattcacagtatctacctttgagggctgtagtgaaggtaaataagattatgtaaatgcccagcctggttgcagcagcaacagtaagcactccaggggtacctgttagatgaataaatgaaagaaactgggaaagacggtgaggagctaagtgttaacactgatatgcagagtctttgccctcattttcagttctgatgggcgcctgacataagcaccttaccctgagcccagagccatgcgcagtattctaaggggccttgaatatgctgtgatttttggccattccactgcaatagaaattgggttggacttaaggcttcttctactgcactgaagagctacacttcttacctctttcaaagtggaaaaacaatctgcgtaagacaatatgatgttaaaaacaaatcaattagtactacacattttcaaattatcagccacgttaatgatgttgaataaaaggtaaccagaaggccagccacctccttagtttttgtttttgtttttgtttttgtttttaaccttggtttattccactgctattttattcctcagtcattgtgccttcaacagaatgccttagcattcgtggcttcctccctgtatggattcccaatcattcaactaccccgcaaatgcttcctgtccatcttctgtgtgcctagcactgcgtgtaagtccatgggaaataccaggaagctgaagaccctgttaacacttccagggagcctgtaattggagagatatgatatatgaatcagtatcacaattaaaaattaaatattcctttttgctggacttatcatccatagaaatttcatataacaattcatgagttatataaaagtgcagtaaaataatactctaagagctgccacaaggcatataggatgaagtgccagttgaatgtaggcctatcctgtaagtgctgtgaatgtacagaatggagagatccttgtgaactggagggtcaagaaagcctttgggccaggtacagtggctcatgcctgtaatcccaacactttgggaggccaacgtgggaggattgcttgaggccagaaattcaagaacagtctgaacaacatagctagaccccatctcttcaaaaaaagaaaaaaaattagtctgatgaggtggctgaagtgagctgtgatcgtgtcactgcactccagcctgggtgacagagcaagacttagtctc

SEQ ID NO: 39371 - DNA, 383 bp, Homo sapiens
gggaggcctggcaaccacagtgttctttctcctgtttatttgttcttggatcttcctgaagccatttcaccaccagccttcatcttctctgccagccccatggagactcaagctttttccagcctatgtcagggaaggagaaccagagacagcaacctcgggtgtgaagggagtcagctctgaacccaggactatggccttctgccactgcctgctttcctcttgctgctggggcctaggtcttcttgctgctgcttccttttccgctaatcaagagtccagggaggtgggaacagcctcaacaaagactttgaagatgagcggggaggatcgcttgagcccaggagcccagcctgggcaacaggggaagacttcgtctctac

SEQ ID NO: 39372 - DNA, 660 bp, Homo sapiens
acagcagtactgagcatgctgggagcttgggacttggagatgaatgagccaccgttgctgctccaagtaggactacttggagtgtagctgaggccttggacgcagtatgaccaggggcagctctgccagggctgttggccaatcagtcattttcatttcttgttggaggccaggtcctctgctgaactcatttcctagctagtgttaccctaattctgatgaagatcaatggggctataattcttgtttttgttcctctttgcagcattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39373 - DNA, 659 bp, Homo sapiens
tttcccaagtgcagggtcagtgttctgggtctgggtgtgttttctaagctgtgtgtgggtgttctgccggccctggggcagacctgtgccaggcaggcctctttgctgcctgctgaaaggcctgtgtccttgtcccggcttcctggtctccaggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagttgtaggcctggctgccttgcatgcaccaggggctttcttcctcctaatcaacaactcagcaccgtgacttctgctaaaatgcaaaatgagatgcgggcacta

SEQ ID NO: 39374 - DNA, 574 bp, Homo sapiens
gcctggcagtcccggcctgcttgggggcacctggacccctgccagggaaggggtcctcagacttgaggttgccagctcagatgtggggctgctgatactaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctggcttcatcaccttggggggcataggccgcagaggacgacgcgatggcaacgaggggcacgtcacctctgcgtacgaaggtatgcaacgtcgggcagcgaaggtcgcacagcgttgcaggccagatgggcgagcgacgggaaaaacacccaggacagcgaaccatcgactgaggaacacacaagag

SEQ ID NO: 39375 - DNA, 3235 bp, Homo sapiens
gcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtgagtcctgccttcttcctcatctggaaacatcacaggggcagctgactgagccatcctcagaggccaggagcaagctagaggaccaagcgaggcgaggggaaccacaccatgccactgggctagcctggcctgctcctgtgttgatggacatagatcagggagatgcttatataataaaccattgcgcccccctctagcctgtggtctctgaattaggaagtcatgggcacgagctgtcgcctgcggagttcctcagcctgcccatccggcctctttccctgcagatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39376 - DNA, 3326 bp, Homo sapiens
gcctggcagtcccggcctgcttgggggcacctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtgagtcctgccttcttcctcatctggaaacatcacaggggcagctgactgagccatcctcagaggccaggagcaagctagaggaccaagcgaggcgaggggaaccacaccatgccactgggctagcctggcctgctcctgtgttgatggacatagatcagggagatgcttatataataaaccattgcgcccccctctagcctgtggtctctgaattaggaagtcatgggcacgagctgtcgcctgcggagttcctcagcctgcccatccggcctctttccctgcagatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39377 - DNA, 1624 bp, Homo sapiens
ctgcaattccgctcctccctcctgcgttggccgttctgtgtgtgtgactcacctcctcttctgtttaaagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39378 - DNA, 390 bp, Homo sapiens
taatctcatgcattccatgttgaaccagaagcatgagtggttctctgaaacccagttacttctcaccccttcatgtcggcagggtgttcagggggccgccagttagagggcacttgagaacatcaaagggaccctttgtggagcacccctactgtgtgccccctccctcccagccagctcacacaccactaatggcagctccatttgcaggagatcctgtcggcctgctgggctttcgacctgcaggagagacccagcttcagcctgctgatggacatgctggagaaacttcccaagctgaaccggcggctctcccaccctggacacttctggaagtcagctgagtaagtgcctcttccatgagccagactgccagccaggccctcgcag

SEQ ID NO: 39379 - DNA, 1197 bp, Homo sapiens
gcctggcagtcccggcctgcttgggggcacctggacccctgccagggaaggggtcctcagacttgaggttgccagctcagatgtggggctgctgatactagcggctgaagttctggtccgttcacatttgtaatgccatggaggccagtgcaagctgcatggggtggctcccggatgagaggacccctaggagctcaacaagacatacctcctcgcattcatggctgagctggcatgatactagctttctaatctgtgagggtccggagtgtgagtgcacgcgagatcccgacggaggacccgtcacgctcggaatgcccgtgccttgtgccgtagtgaattggatggccgagagagtgcagacgtggagtactgctgccggctgctggtgcggggcctaggcggcggtatgcacgtggtggccgttcgtgtcgagatgattgcccgtctaccctggccgtgccggacaggtgtgtagcaggcgctgggcagggcggcatgcgacataacaggcagtgcactccgagcttcggaagttccatttggaattgcgctggccgcgtggaaagtcgcgcgtcaaagcggcgcttcctacgggtacgaccgcgtcgtacagcaaggcgcccagccattgccctttggcccctcgaggggagctcctcgaggcatgtgcggcaggcagtcgaggcaactagcgtcccgagtggcccatcggcgtaccaatccttccggtcggtcaggtctcgttcacctggcgcgtacaacgaagcttcccctgcaagccctgaggttatcccgctgagggggtcctcttacaggattagactggtcattcgcccctttgcggacagccctatgtgtggcgcagggcctttggaggcggttcccggctttccggatgagcctcagggggtgaccctctccaagccgccggtattcacgtggttgcccccgaaaccggggaccccgttgggcgcgtccgggggtcaggcccttccctttgaaggtcttacccggtggggcgcgaatgccggccgctttggcgcaaggtgtggctcgcctggtggtcatcctgggtgtgccggggacacccttcggccgacccgcgggggccccctttcctcgttggtggcctattcggggcgtcgttcgcagcaatcctcggtagccgtagcggagagtaagacccttcctctg

SEQ ID NO: 39380 - DNA, 465 bp, Homo sapiens
gcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggtaagtgggtcggggaccaggctgggctcgaggagcgggcccggacacctccctccgggccccagtactcctggccgagttgcatccttgagcccgcgtcgccccccttggaggcttcccctccctcctgcactcgctgatgcggcagccggaggacccgggaccagccctcatcttgggcaggatttgtggggcgggtgcgtcgtgggaactgggatggaggctcgaggggcccgtgcggggtgggctgcgcgcggacatcccctttccccccttctccgcccccaccccatttccagtttg

SEQ ID NO: 39381 - DNA, 3368 bp, Homo sapiens
gcctggcagtcccggcctgcttgggggcacctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtgagtcctgccttcttcctcatctggaaacatcacaggggcagctgactgagccatcctcagaggccaggagcaagctagaggaccaagcgaggcgaggggaaccacaccatgccactgggctagcctggcctgctcctgtgttgatggacatagatcagggagatgcttatataataaaccattgcgcccccctctagcctgtggtctctgaattaggaagtcatgggcacgagctgtcgcctgcggagttcctcagcctgcccatccggcctctttccctgcagatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39382 - DNA, 3220 bp, Homo sapiens
gcctggcagtcccggcctgcttgggggcacctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtgagtcctgccttcttcctcatctggaaacatcacaggggcagctgactgagccatcctcagaggccaggagcaagctagaggaccaagcgaggcgaggggaaccacaccatgccactgggctagcctggcctgctcctgtgttgatggacatagatcagggagatgcttatataataaaccattgcgcccccctctagcctgtggtctctgaattaggaagtcatgggcacgagctgtcgcctgcggagttcctcagcctgcccatccggcctctttccctgcagatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39383 - DNA, 3510 bp, Homo sapiens
gcctggcagtcccggcctgcttgggggcacctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtgagtcctgccttcttcctcatctggaaacatcacaggggcagctgactgagccatcctcagaggccaggagcaagctagaggaccaagcgaggcgaggggaaccacaccatgccactgggctagcctggcctgctcctgtgttgatggacatagatcagggagatgcttatataataaaccattgcgcccccctctagcctgtggtctctgaattaggaagtcatgggcacgagctgtcgcctgcggagttcctcagcctgcccatccggcctctttccctgcagatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacagacgtaaatgtgaagccagttggagtttgtgctatgcagcagtgttagccaggatctcattagcgtgcaaacctagcatcttctgtgccacaagccacacacttgctttttttgaatgtgatgtaaaatttgtacagtaaagtttttatattttctatcaactacatttgtcttccagacatgctattaatttaaattaaaatggttagtattaac

SEQ ID NO: 39384 - DNA, 3434 bp, Homo sapiens
gcctggcagtcccggcctgcttgggggcacctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtgagtcctgccttcttcctcatctggaaacatcacaggggcagctgactgagccatcctcagaggccaggagcaagctagaggaccaagcgaggcgaggggaaccacaccatgccactgggctagcctggcctgctcctgtgttgatggacatagatcagggagatgcttatataataaaccattgcgcccccctctagcctgtggtctctgaattaggaagtcatgggcacgagctgtcgcctgcggagttcctcagcctgcccatccggcctctttccctgcagatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39385 - DNA, 2008 bp, Homo sapiens
caagggctgtcccaggcacccattgcagaggtgcatgtcagggaagaacgatgaggaatgcaatggagcaagcttgtccaagctctgtcttccccacactccccaggtgattgtagccagggtcaagaaccactgccttgacccttgaacaaaagtgtcagccaaggctggatccctccattgcattatggcttggagaatgttaacagactgatttactcctgcccaggggagagtcagaaactctgtgtttaaacaagagttccagaaggatggatgcagtgaaattcttctatgccagggatgctcttgctctttcctggacaattagatgttgctcacaggtaggtattggagtattagcatgatgaagggcctcaggtcaccgggccagccgccacatattgtggatgaggacattgaggtccactgatgctaagtgagctgcacagcaggccagtgcagagctgcaactacaacctgggtcccctggcaggatgcctctctcccctgttacctggctagggctccaggagaaggaagagacgtcgcagagcccagatctgctgcccatccctgttcttcctgctctcctttcaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactaaaaaaga

SEQ ID NO: 39386 - DNA, 1681 bp, Homo sapiens
taaaattcaattgaaatgaaatgaaaacgtaagcatttaatagtggttttaaaaatcagtaacttttgttcatctgtgttttctttttagaatgaagtgatggaggctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtttgtttttgttttgtttcgttttgttttttgagacagggtctcgttctgtcgcttagctggagtgcggtggcgtgatcatggcactgctattcttgaagcactccacccacctgggctactttttctttagtgcagaggtgcactgtcttcttttaggtgggatcgcgtaagcatgagctggtagagcacggagaggcaggcagccaggttacgaagactaagccaattattcactgaagtcatcctcctctcccccaccattcgatttgatctacctctaagccaggctgtgaagaaaaggaaggcactttagaagacctcagcagtgtggttctgtgtctacttccatgacctgtacctgagtatcttagccagccagccttaggaacaccaccaaggttactttgaaatctatgtatatagctagttacagacgggagctatgtgtttcttcattattttgcagctcctcgttgttcctgtgattcctgaacacctttttggaaatatgggtctctgtgagttttgagcacactactatcactttggatagtcactccatttatatttttataaacttccattagagaatcattaaggctgtttaatatctgctctggatattacgcattggctttttgttgcctagtgctacaaaccttcctgtgggactcagtgtcttcaggcaatgattgtgtatcctgttacagatggttgtgatacaagaagaaccactcttctttgaaaataaactcttggaagcttttgccagctatctggggggtaggaggaatattagcaactgtattggttgtctacagatacagaattgcctgttgtgagggaactgattgttttgttgggaaaagaaatttaccaggagaaagagttttgtgctgtattgtgagagatctcgcctctcagttaaatgagccctgggttaaagtcagtgtgaagggcagctgtgtgcgggcacgagccagagtgtctgcctcagactagatttgacttgagttctttatgacccaggactctggataatgtgaatttgctttcctatttaactagaagatacatgtactatagatcattgtctcattttagtgattgttccttaaactagtgaaactagtggatttctcttcttcctctttattttttgcatgttaaatgtgaaccttagtgtatttgtattttgtagaaaataatgaaaaattttaatggagaatgatttaaaaacatttacaatacattatttttgcatctgtgttgttgcattcccattggctg

SEQ ID NO: 39387 - DNA, 2257 bp, Homo sapiens
ctttccctgccggcacagtggacctggcccaaccctcacagccagtagacgagctggagctctcggtgctcgagcggcagccagaagagaacacgcctctcaatggtgccgacaaggtcttcccttctttggacgaggaggtccccccggccgaggctaacaaggaaagcccctggagctcctgtaataagaatgtggttggaagatgcaaactgtggatgatcatcacctccattttcctaggtgtcattacagtgatcatcataggcttatgtcttgctgcagtaacttatgttgatgaagatgaaaatgaaatacttgaattatcatcaaacaaaacattcttcatcatgctgaagattccagaggagtgtgttgctgaagaggaattgcctcacctgctcaccgaaaggctcacagatgtgtacagtacatcgccctctctgagtcgttattttacttcagttgaaatagtggacttcagtggtgaaaatgccacagtaacgtatgacctgcaatttggggttccatcagatgatgaaaattttatgaagtatatgatgagtgaggagttggtgctgggcattttgctacaggatttccgtgatcagaatatacctggttgtgagagtctggggcttgatccaacatccctcttgctctatgaatgaagtgatggaggctggtctctgtctgaaagcagtgctctaccaagtcctggagatgaagggaattcactctgttttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtttgtttttgttttgtttcgttttgttttttgagacagggtctcgttctgtcgcttagctggagtgcggtggcgtgatcatggcactgctattcttgaagcactccacccacctgggctactttttctttagtgcagaggtgcactgtcttcttttaggtgggatcgcgtaagcatgagctggtagagcacggagaggcaggcagccaggttacgaagactaagccaattattcactgaagtcatcctcctctcccccaccattcgatttgatctacctctaagccaggctgtgaagaaaaggaaggcactttagaagacctcagcagtgtggttctgtgtctacttccatgacctgtacctgagtatcttagccagccagccttaggaacaccaccaaggttactttgaaatctatgtatatagctagttacagacgggagctatgtgtttcttcattattttgcagctcctcgttgttcctgtgattcctgaacacctttttggaaatatgggtctctgtgagttttgagcacactactatcactttggatagtcactccatttatatttttataaacttccattagagaatcattaaggctgtttaatatctgctctggatattacgcattggctttttgttgcctagtgctacaaaccttcctgtgggactcagtgtcttcaggcaatgattgtgtatcctgttacagatggttgtgatacaagaagaaccactcttctttgaaaataaactcttggaagcttttgccagctatctggggggtaggaggaatattagcaactgtattggttgtctacagatacagaattgcctgttgtgagggaactgattgttttgttgggaaaagaaatttaccaggagaaagagttttgtgctgtattgtgagagatctcgcctctcagttaaatgagccctgggttaaagtcagtgtgaagggcagctgtgtgcgggcacgagccagagtgtctgcctcagactagatttgacttgagttctttatgacccaggactctggataatgtgaatttgctttcctatttaactagaagatacatgtactatagatcattgtctcattttagtgattgttccttaaactagtgaaactagtggatttctcttcttcctctttattttttgcatgttaaatgtgaaccttagtgtatttgtattttgtagaaaataatgaaaaattttaatggagaatgatttaaaaacatttacaatacattatttttgcatctgtgttgttgcattcccattggctg

SEQ ID NO: 39388 - DNA, 240 bp, Homo sapiens
cgccggcgctgtggcctcccgcggagccgctcagactttccctgccggcacagtggacctggcccaaccctcacagccagtagacgagctggagctctcggtgctcgagcggcagccagaagagaacacgcctctcaatggtgccgacaaggtcttcccttctttggacgaggaggtccccccggccgaggtaaggtccccttggcgctggccctaacttgccggcggcgggacagtagt

SEQ ID NO: 39389 - DNA, 2876 bp, Homo sapiens
ggagttccaagggctgatgctgggaaccttgctctggatgcgaggcctgcccctggagggagccgcggaggactggcagctgcagatgctggagcaggccagcctgtggctgggccgtagcttcctgctggcaggcttcctggtatcgagcagctgccccagcctggagcaggcggccaagggtgagggctgttcccccatcccttgtttcgcccactgcctcgactccctggtgagaaactttctgtgtcaccctcacagtgtccagatcatcctgggcactgccagggccacctgcagccatttctaaggctctgtggaggcccagggactcctcacccagctccagcgccagcgcagcctcctagcccaccagccctttgaggagctcttggaccactgggtctcggcctaccacctgctggagtggctggtggagcagcagcagccccttcaagagtacaagggcaggcaccagctggggaaggctggtgttgccttgtcggccacattctggagcccggcagacagcctcagcaagctcctgtagcccttccagatggtggtccgcgaggcgagtgcggcacaggcctctctgagccaggtgctgccccagctgcgctacctgcacatcttcctggagcaggttcacacacactttcaggagcagagtgtcggggagaggggcgcagccatccagctggctgaggggttggcccggcagctctgcaccgactgtcagctcaacaagctcttctaccgcgaggagtttgtgctggccaccttgctggacccttgcttcaaggggaagattgaggccatcctgccatgggggccgaccgacattgaccactggaagcaagtcctcgtgtacaaggtgaaggagattagagtgtctgaatactctttgaactccccaagtcccctgcaaagccccaggggtctgtgcgtggaccccaccagggtagccaagagctccggggtggaggggagaagccagggggagcctctgcagagcagcagccactctggggccttcctgctggcccagagggagaagggcttgctggagagcatggggctgctggcctctgagagaagcgggggctcgctgtccaccaagagccactgggccagcatcattgtcaagaagtatctgtgggagaatgagaccgttggagcccaggatgaccccctggcttactgggagaagaagcgagaagcctggccaccatctatctgtcttaccccccacaggagccttctctgaaagcatctttgcctccctgaacagccccacccttgtagagcaaaactcttctctcaaggtggaagccattgagcatctcctcttcttgaaggccaacctggagcagttccccaactacaccccgcctcccctcatctgctctagtggtgacctggccaaggggatacagaccctgcagtccgctcagggtgggatggcagacatggcaggtgccggtgctcaccctgcccgtgaactcctagagagcccctgcctgtaataggtcaaagcagagagctgggtgttgcatcctgggcgccacatgctcatggccagaatcttaaacctatttggtaggaaagggtcagtttctcacttgacagattgccatatttttttttctgggagatgtcattttccatctcccgattacttcctttacgtctagcagtatgtgccgagaagaggcttactctcttcgtaggtgactgtgaattttgtactacgtggctttgtacatgtgatgctctgttaaaacataagtgggtatgaaggtccttgcatacaccttgtctgtgtggataagtggacacatgcccttaagaggcttgctttctcaaaaagtggccaaggatgtggagtgggcatgtgctggcaggtgggatatgtcctcagcctttgggggcctggataagctattgcagcactttctgaggctttcactgtagggagaaggaaaccccaagggtagaatagccatttccagagggaagtacacacatacccccacacaccagtctttttgggggtttcagagtggccggagaaaccgactgaagggactgaccagctagctaggagagctgagacgccagtcctcaaatggcgttcttaccaatagtctatttccagactactggaaacgttggggtttcttcctccagtgacagcagcctcagtagctttcctgggctccaggcggctggctgcacaccctgcctgccatcacccttgcccctgcttgtcctggaccacttttaaaggggaagtcccttatttggaagagagaaaggatgtgtgtagcacacactcatcatggattgctcagagttcctttagggcagagctgagggcctgggatccaggaaccagtgggattggatgggagaagaaggaagggggtggcccgtcacccccgcaagacttgcatccaggtagcctaaggactcctggtcactgggtagggtggctgctgagatgcaggtcggaagaggcaggggaaggctccaggcctaacttggagcatgtcactggccatgggggtgaggggacagactctgctctcactggctggcagccccaggagcctgttcccttgcctctcctggatgggttgtcagccctgtgtttcactgtgaccaattcattataacatttggatattactgaaaatgtaaggaagcaggaaaaattaactactttcattcagagatagcctctatcaatagtttgacatttttccctcttttacattgagatcataccctaggtactgtttagtatgcaatattttcattttcgcagtataataattgcacctgttaaataaagttttgtaaacatttaa

SEQ ID NO: 39390 - DNA, 2668 bp, Homo sapiens
ggagttccaagggctgatgctgggaaccttgctctggatgcgaggcctgcccctggagggagccgcggaggactggcagctgcagatgctggagcaggccagcctgtggctgggccgtagcttcctgctggcaggcttcctggtatcgagcagctgccccagcctggagcaggcggccaagggtgagggctgttcccccatcccttgtttcgcccactgcctcgactccctggtgagaaactttctgtgtcaccctcacagtgtccagatcatcctgggcactgccagggccacctgcagccatttctaaggctctgtggaggcccagggactcctcacccagctccagcgccagcgcagcctcctagcccaccagccctttgaggagctcttggaccactgggtctcggcctaccacctgctggagtggctggtggagcagcagcagccccttcaagagtacaagggcaggcaccagctggggaaggctggtgttgccttgtcggccacattctggagcccggcagacagcctcagcaagctcctgtagcccttccagatggtggtccgcgaggcgagtgcggcacaggcctctctgagccaggtgctgccccagctgcgctacctgcacatcttcctggagcaggttcacacacactttcaggagcagagtgtcggggagaggggcgcagccatccagctggctgaggggttggcccggcagctctgcaccgactgtcagctcaacaagctcttctaccgcgaggagtttgtgctggccaccttgctggacccttgcttcaaggggaagattgaggccatcctgccatgggggccgaccgacattgaccactggaagcaagtcctcgtgtacaaggtgaaggagattagagtgtctgaatactctttgaactccccaagtcccctgcaaagccccaggggtctgtgcgtggaccccaccagggtagccaagagctccggggtggaggggagaagccagggggagcctctgcagagcagcagccactctggggccttcctgctggcccagagggagaagggcttgctggagagcatggggctgctggcctctgagagaagcgggggctcgctgtccaccaagagccactgggccagcatcattgtcaagaagtatctgtgggagaatgagaccgttggagcccaggatgaccccctggcttactgggagaagaagcgagaagcctggccaccatctatctgtcttaccccccacaggagccttctctgaaagcatctttgcctccctgaacagccccacccttgtagagcaaaactcttctctcaaggtggaagccattgagcatctcctcttcttgaaggccaacctggagcagttccccaactacaccccgcctcccctcatctgctctagtggtgacctggccaaggggatacagaccctgcagtccgctcagggtgggatggcagacatggcaggtgccggtgctcaccctgcccgtgaactcctagagagcccctgcctgtaataggtcaaagcagagagctgggtgttgcatcctgggcgccacatgctcatggccagaatcttaaacctatttggtaggaaagggtcagtttctcacttgacagattgccatatttttttttctgggagatgtcattttccatctcccgattacttcctttacgtctagcagtatgtgccgagaagaggcttactctcttcgtaggtgactgtgaattttgtactacgtggctttgtacatgtgatgctctgttaaaacataagtgggtatgaaggtccttgcatacaccttgtctgtgtggataagtggacacatgcccttaagaggcttgctttctcaaaaagtggccaaggatgtggagtgggcatgtgctggcaggtgggatatgtcctcagcctttgggggcctggataagctattgcagcactttctgaggctttcactttcttcctccagtgacagcagcctcagtagctttcctgggctccaggcggctggctgcacaccctgcctgccatcacccttgcccctgcttgtcctggaccacttttaaaggggaagtcccttatttggaagagagaaaggatgtgtgtagcacacactcatcatggattgctcagagttcctttagggcagagctgagggcctgggatccaggaaccagtgggattggatgggagaagaaggaagggggtggcccgtcacccccgcaagacttgcatccaggtagcctaaggactcctggtcactgggtagggtggctgctgagatgcaggtcggaagaggcaggggaaggctccaggcctaacttggagcatgtcactggccatgggggtgaggggacagactctgctctcactggctggcagccccaggagcctgttcccttgcctctcctggatgggttgtcagccctgtgtttcactgtgaccaattcattataacatttggatattactgaaaatgtaaggaagcaggaaaaattaactactttcattcagagatagcctctatcaatagtttgacatttttccctcttttacattgagatcataccctaggtactgtttagtatgcaatattttcattttcgcagtataataattgcacctgttaaataaagttttgtaaacatttaa

SEQ ID NO: 39391 - DNA, 3203 bp, Homo sapiens
ggagttccaagggctgatgctgggaaccttgctctggatgcgaggcctgcccctggagggagccgcggaggactggcagctgcagatgctggagcaggccagcctgtggctgggccgtagcttcctgctggcaggcttcctggtatcgagcagctgccccagcctggagcaggcggccaagggtgagggctgttcccccatcccttgtttcgcccactgcctcgactccctggtgagaaactttctgtgtcaccctcacagtgtccagatcatcctgggcactgccagggccacctgcagccatttctaaggctctgtggaggcccagggactcctcacccagctccagcgccagcgcagcctcctagcccaccagccctttgaggagctcttggaccactgggtctcggcctaccacctgctggagtggctggtggagcagcagcagccccttcaagagtacaagggcaggcaccagctggggaaggctggtgttgccttgtcggccacattctggagcccggcagacagcctcagcaagctcctgtagcccttccagatggtggtccgcgaggcgagtgcggcacaggcctctctgagccaggtgctgccccagctgcgctacctgcacatcttcctggagcaggttcacacacactttcaggagcagagtgtcggggagaggggcgcagccatccagctggctgaggggttggcccggcagctctgcaccgactgtcagctcaacaagctcttctaccgcgaggagtttgtgctggccaccttgctggacccttgcttcaaggggaagattgaggccatcctgccatgggggccgaccgacattgaccactggaagcaagtcctcgtgtacaaggtgaaggagattagagtgtctgaatactctttgaactccccaagtcccctgcaaagccccaggggtctgtgcgtggaccccaccagggtagccaagagctccggggtggaggggagaagccagggggagcctctgcagagcagcagccactctggggccttcctgctggcccagagggagaagggcttgctggagagcatggggctgctggcctctgagagaagcgggggctcgctgtccaccaagagccactgggccagcatcattgtcaagaagtatctgtgggagaatgagaccgttggagcccaggatgaccccctggcttactgggagaagaagcgagaagcctggccaccatctatctgtcttaccccccacaggagccttctctgaaagcatctttgcctccctgaacagccccacccttgtagagcaaaactcttctctcaaggtggaagccattgagcatctcctcttcttgaaggccaacctggagcagttccccaactacaccccgcctcccctcatctgctctagtggtgacctggccaaggggatacagaccctgcagtccgctcagggtgggatggcagacatggcaggtgccggtgctcaccctgcccgtgaactcctagagagcccctgcctgtaataggtcaaagcagagagctgggtgttgcatcctgggcgccacatgctcatggccagaatcttaaacctatttggtaggaaagggtcagtttctcacttgacagattgccatatttttttttctgggagatgtcattttccatctcccgattacttcctttacgtctagcagtatgtgccgagaagaggcttactctcttcgtaggtgactgtgaattttgtactacgtggctttgtacatgtgatgctctgttaaaacataagtgggtatgaaggtccttgcatacaccttgtctgtgtggataagtggacacatgcccttaagaggcttgctttctcaaaaagtggccaaggatgtggagtgggcatgtgctggcaggtgggatatgtcctcagcctttgggggcctggataagctattgcagcactttctgaggctttcactgtagggagaaggaaaccccaagggtagaatagccatttccagagggaagtacacacatacccccacacaccagtctttttgggggtttcagagtggccggagaaaccgactgaagggactgaccagctagctaggagagctgagacgccagtcctcaaatggcgttcttaccaatagtctatttccagactactggaaacgttggggtttcttcctccagtgacagcagcctcagtagctttcctgggctccaggcggctggctgcacaccctgcctgccatcacccttgcccctgcttgtcctggaccacttttaaaggggaagtcccttatttggaagagagaaaggatgtgtgtagcacacactcatcatggattgctcagagttcctttagggcagagctgagggcctgggatccaggaaccagtgggattggatgggagaagaaggaagggggtggcccgtcacccccgcaagacttgcatccaggtagcctaaggactcctggtcactgggtagggtggctgctgagatgcaggtcggaagaggcaggggaaggctccaggcctaacttggagcatgtcactggccatgggggtgaggggacagactctgctctcactggctggcagccccaggagcctgttcccttgcctctcctggatgggttgtcagccctgtgtttcactgtgaccaattcattataacatttggatattactgaaaatgtaaggaagcaggaaaaattaactactttcattcagagatagcctctatcaatagtttgacatttttccctcttttacattgagatcataccctaggtactgtttagtatgcaatattttcattttcgcagtataataattgcacctgttaaataaagttttgtaaacatttaaaaaaaaaaaaaaaaaaaaatcggggatatagggggggggggaaagaggtactgaatggcctggtcctaggtgttcctgacccagttttggttacaaggtgggaaaatctggcggttcccctaagggaggcgataaattttggaaagccgggtaacgtatatttggaaaaaacaaagccacgggacgcgcccggcagcaccggggggagacaccttgtcaaaccggcgtgcaagacaccactcggaccgcccgcccccgacaaccaccaaccccaccaccgaacgcagacacgaaaccgacacgcgcgacacacgagcgacaacaaga

SEQ ID NO: 39392 - DNA, 217 bp, Homo sapiens
gaagaatctgaactttaagggtcccaccaaaatgttaaaatgaaccattctaagtagcactatggtagtcataaacagaactaagtattttgaaaacaaacagtttagagtttggctggggatggttgctcacacctaaaatcccagcacttagggagccagaggcaggaggagaccctgagtccaggagtttgagacctgtctggcaacagagcaa

SEQ ID NO: 39393 - DNA, 2010 bp, Homo sapiens
ccggcggcgccaagcttgcggccgcggcggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaacacttttctggctcttggtattggtttgcttgttttgagtttgtttcactccagtttgccccttcc

SEQ ID NO: 39394 - DNA, 1364 bp, Homo sapiens
ccggcggcgccaagcttgcggccgcggcggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtctaggagcgtaatcggaccggctcgatga

SEQ ID NO: 39395 - DNA, 1942 bp, Homo sapiens
ccggcggcgccaagcttgcggccgcggcggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacg

SEQ ID NO: 39396 - DNA, 1791 bp, Homo sapiens
gaattcgcggccgcgtcgacctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacg

SEQ ID NO: 39397 - DNA, 830 bp, Homo sapiens
ttgcggccgctgcccctcgtggtggtccctggcttgctgcagctgctattttgtgacagtaaggaagtggtgcatgccacggaggggctggattgggaagacaaagatgctccagggacgttggtcggcaacgtggtgcactcaaggatcatcagtcccctgcgcctgtttgttaaacagtctccggtgcccaagcccggccccatggcgtatgcagacagcatggaaaacttttgggattggctggccaacatcacggagattcaggagccattggcaagaactaaacggaggccaatagtaaaaacaggaaaatttaagaaaatgtttggatggggtgactttcattccaacattaaaactgtcaaactcaatctcctcatcacagggaaaattgttgaccatggaaatggaaccttcagtgtgtatttccgacataattcaacaggcctgggcaatgtttcagtgagcttggtaccaccctccaaggtggtggaatttgaagtttccccccagtctaccttggagaccaaggaatccaaatctttcaattgtcgcattgagtatgaaaaaacagatcgggcgaaaaagaccgccctgtgcaactttgacccatccaagatctgctaccaggagcagactcagagccatgtgtcttggttgtgctccaagcccttcaaggtcatttgcatttacattgccttttacagtgttgattataaactcgtgcaaaaggtgtgccctgactacaattaccatagtgagaccccatacttatcttctggctgatcttcctgctgtggtggaaatgagggatacatatgtatttg

SEQ ID NO: 39398 - DNA, 1399 bp, Homo sapiens
aatatgttttggaaggttaccgcagaaacagcagatgcggtaaaggaaaagattgtatttgatagatgaattgtgtttttgacattggacccttttttttatatttctatcttttcccccatccatctgtgctgttattgatatgagagaaaaaaaggtaaaatttgtttcaaaattcatgtgtgaagttacagtgccacagtggaaccaagttccttatcatctgagctacagttgcgtggaatgtgatttgagcacttagccctgtgttggtcaccattcttatgattccccctgagtttgaatactgatgtaatgggaaagcaaatctgagaataagtttgttgaacgataacaaaaatcatgatgtttttagactcttctgataaattcaaatgctgtggaattaatcaaaaaatgacaaaatttgtatgcatcctatagcttagagctttgttcaattcattcgatagtgtgattctttacacatgtgtagaacagctctgaagttgagtgaaagtgcttgtttcctagactagaatagaaaacaaaagtgggaagtagagggaggaaatttcaggattatggattcattatttctagcctcccagattaagttccccttgcatttagttaatatttgaataagagatcaaactctatgtggaaatagagagttatatttaaacatttctaattattaagtgctgacaaccaagatacctggcttaccagacttttgaaatgactttcaaattaatgtcacttcacagtcagtgcccttctcatcttccctgtgggggtgaatagcagtcctatatggtagaactgaatgatcattaaattagaacagaaacaggggtctggttggccaagaaaaaggcttctagaactcaggacgctcatggaatggtcactccttttacaatagatgttaacttctttctcccttcttatctgtaaaatattaattaaagtaaaacattaaattgaggactaaaggaagagaagtcctaaacaacaagaaatactcttaccacactgttcaaaaaaccaagagctctgttctctatcttcatttctttccttttaccggtaatatctgcagtgttcaatttttgtcttttgtaaaaattgtactaagcttagtgtgtggtagtacaggcttgaagttcttgctctgagttcaccacatgtttttgtaattttgtggttggtgattaatattttgaaacatctttttattttcacctagaaacaagagtaaaatattatttattgtaaaatatgtgggaatcatatatctatatatatatacttagaattttctgtgtacagagaaagtatgtgtacacattttatgtaaataaaaagaatttgctagatctgtcacattaat

SEQ ID NO: 39399 - DNA, 1508 bp, Homo sapiens
ttgcggccgctgcccctcgtggtggtccctggcttgctgcagctgctattttgtgacagtaaggaagtggtgcatgccacggaggggctggattgggaagacaaagatgctccagggacgttggtcggcaacgtggtgcactcaaggatcatcagtcccctgcgcctgtttgttaaacagtctccggtgcccaagcccggccccatggcgtatgcagacagcatggaaaacttttgggattggctggccaacatcacggagattcaggagccattggcaagaactaaacggaggccaatagtaaaaacaggaaaatttaagaaaatgtttggatggggtgactttcattccaacattaaaactgtcaaactcaatctcctcatcaccattcttatgattccccctgagtttgaatactgatgtaatgggaaagcaaatctgagaataagtttgttgaacgataacaaaaatcatgatgtttttagactcttctgataaattcaaatgctgtggaattaatcaaaaaatgacaaaatttgtatgcatcctatagcttagagctttgttcaattcattcgatagtgtgattctttacacatgtgtagaacagctctgaagttgagtgaaagtgcttgtttcctagactagaatagaaaacaaaagtgggaagtagagggaggaaatttcaggattatggattcattatttctagcctcccagattaagttccccttgcatttagttaatatttgaataagagatcaaactctatgtggaaatagagagttatatttaaacatttctaattattaagtgctgacaaccaagatacctggcttaccagacttttgaaatgactttcaaattaatgtcacttcacagtcagtgcccttctcatcttccctgtgggggtgaatagcagtcctatatggtagaactgaatgatcattaaattagaacagaaacaggggtctggttggccaagaaaaaggcttctagaactcaggacgctcatggaatggtcactccttttacaatagatgttaacttctttctcccttcttatctgtaaaatattaattaaagtaaaacattaaattgaggactaaaggaagagaagtcctaaacaacaagaaatactcttaccacactgttcaaaaaaccaagagctctgttctctatcttcatttctttccttttaccggtaatatctgcagtgttcaatttttgtcttttgtaaaaattgtactaagcttagtgtgtggtagtacaggcttgaagttcttgctctgagttcaccacatgtttttgtaattttgtggttggtgattaatattttgaaacatctttttattttcacctagaaacaagagtaaaatattatttattgtaaaatatgtgggaatcatatatctatatatatatacttagaattttctgtgtacagagaaagtatgtgtacacattttatgtaaataaaaagaatttgctagatctgtcacattaat

SEQ ID NO: 39400 - DNA, 738 bp, Homo sapiens
tttagacttcccaaagagtcattatgttgagtaaaaataatttagtcttttctttttgtttggcttaacttttcttccctcctaccctatatcttttgtcttccaagatattataactaggaagagttagcatatataattatgctattatctcagaccctgagataccctgtaggacagattcacaacagagtcatcatttccaggctaatagcagggggttcaccctattcagcattccacattttcctctgtaggcactcacattagttttatattttaggtagcaatatgtgtagtttagctttgtgcaaacatattaggagtagacattcagtgtactgtgtcctggttatctagattctaaagcttcattttataaaaatccagctctgtggggaaagaggggtgttttattaacatgcggcattaacactgctgggctctgtggataggttgacatagtgtcatcgtcacagaagataaaattcgaaggagcatttgtggagagcatgcagtggatattagaacaatatctcaggattttatggtggtttaatcattatccacccctatcctttcgttcacacagtcaacctatattttttaaaattcactacgtgccaggcactgtgttaactgctgtagtgactcaaatgtatgattgcatttatatgagatatccagaataagtaaatccatagagacagaaagcacgttggtcatttctaggggctg

SEQ ID NO: 39401 - DNA, 458 bp, Homo sapiens
gtcatagagcctctactatatttagtttgagaagaattagagtatgcatttcaagttgccataaattatattaagacaaaacatgttagtaaaagaagctaatcaaagtaaaaaaaaaaccagataaaaggtattttgcctattctgttatttttaatttctcttaaagatttgaatgcattgcaccatagactttggaaggacatgttttcccccaaagcctgaaaataatagatgattaagttttctatctaatattatgaaaactctaatttttaaatattctcttaaaattcatttaaactgtagtattttgtttattgcttcttattattcattgtttctttcttgccctggtattatatttgtattgactcacaatagcttatactcacagctgttcctgtcttgattactagtttaatattacaaaagtccattcattgaaaaggaaaaaa

SEQ ID NO: 39402 - DNA, 3525 bp, Homo sapiens
tttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgagatggggttttaccatgttacccaggctggtcttgaactcctggactcaagcaacccccgcttggcctcccaaagtgctgggattagaggcgtgagccactgcacctgacctaagaggaagcagaccagcccactacagagccaggcatggtcctggatagtgtggaagcaggagacacaacacctcctaccaaaaggaagagcaagttctcaggctttggcaagatcttcaagccctggaaatggaggaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaa

SEQ ID NO: 39403 - DNA, 423 bp, Homo sapiens
aaaacaaaacctaggccagcatggtggttcacgcctataatctcagcactttgggaagccaaggcggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaa

SEQ ID NO: 39404 - DNA, 240 bp, Homo sapiens
  misc_feature (39)..(39): n is a, c, g, or t
ggctgagcatgagaagtgggtaaagagaaaagacactgnatgcagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaa

SEQ ID NO: 39405 - DNA, 4048 bp, Homo sapiens
tttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgagatggggttttaccatgttacccaggctggtcttgaactcctggactcaagcaacccccgcttggcctcccaaagtgctgggattagaggcgtgagccactgcacctgacctaagaggaagcagaccagcccactacagagccaggcatggtcctggatagtgtggaagcaggagacacaacacctcctaccaaaaggaagagcaagttctcaggctttggcaagatcttcaagccctggaaatggaggaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgagccaccgtgccgagccttccttgaagttttttgtttggttttgatttgttttgttttgttttgttttgttttgttttgtttttggagatggggtctcactctgttgcccatgctggagtgcagtggcacaatcttggctcagagcaacctctgcctcccaggctcaagcaatcctcccacttcagtctaagtagctgggactacaggcacgtgccgccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcatctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaatacc

SEQ ID NO: 39406 - DNA, 4049 bp, Homo sapiens
tttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgagatggggttttaccatgttacccaggctggtcttgaactcctggactcaagcaacccccgcttggcctcccaaagtgctgggattagaggcgtgagccactgcacctgacctaagaggaagcagaccagcccactacagagccaggcatggtcctggatagtgtggaagcaggagacacaacacctcctaccaaaaggaagagcaagttctcaggctttggcaagatcttcaagccctggaaatggaggaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaattggttagatgaggccaggcgcggtggctcacctcagcctcccaaagtggtgggattacaggcatgagccaccgtgccgagccttccttgaagttttttgtttggttttgatttgttttgttttgttttgttttgttttgttttgtttttggagatggggtctcactctgttgcccatgctggagtgcagtggcacaatcttggctcagagcaacctctgcctcccaggctcaagcaatcctcccacttcagtctaagtagctgggactacaggcacgtgccgccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcatctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaatacc

SEQ ID NO: 39407 - DNA, 420 bp, Homo sapiens
gtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactg

SEQ ID NO: 39408 - DNA, 2988 bp, Homo sapiens
tttttccccctccccgggggccaagggctccggctgctgcctggcggccaacgggccaggtaggatttccgggagaggctgctgtggaggctgaggaggcggcggcggagatctggaaacagtatctcacctccctaaactggttaatagtggcatggaagatccatttgagatggggttttaccatgttacccaggctggtcttgaactcctggactcaagcaacccccgcttggcctcccaaagtgctgggattagaggcgtgagccactgcacctgacctaagaggaagcagaccagcccactacagagccaggcatggtcctggatagtgtggaagcaggagacacaacacctcctaccaaaaggaagagcaagttctcaggctttggcaagatcttcaagccctggaaatggaggaaaaaaaaagtagtgataaatttaaagagacttcagaagttttagaacggaaaatatctatgcgaaagccaagagaagagctggttaaaagaggggttctgttggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaa

SEQ ID NO: 39409 - DNA, 2158 bp, Homo sapiens
cccacaggacatgttttccattcctgcacgaaaaatctctaaaacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaacgagaaattaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaacattttacacgctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgagccaccgtgccgagccttccttgaagttttttgtttggttttgatttgttttgttttgttttgttttgttttgttttgtttttggagatggggtctcactctgttgcccatgctggagtgcagtggcacaatcttggctcagagcaacctctgcctcccaggctcaagcaatcctcccacttcagtctaagtagctgggactacaggcacgtgccgccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcatctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaatacc

SEQ ID NO: 39410 - DNA, 353 bp, Homo sapiens
tcaaaggaggagaagtgatcacactttatgcaacagcctggttagtttgatgtataacttttcaatacttggacatgcagcctgtgcatgccttttatagactcttgctctgggctccgcaatgtcaggggtggcttgggtcatgaggatatcagaattttcttgtggtcgatgatgttttaattttctttactattgttataagtggttttttattacaaaaattagaaattaggtcataaaatgaccaaaatgacaggtttcctttggggggcacagcatggcaatccccagcccacatccccgtcagctcatgcctgggcccccggagtcgccacattgccaggcgccct

SEQ ID NO: 39411 - DNA, 780 bp, Homo sapiens
tgacagggtcttgctctgtcacccaggctggagtgcagtggtgccatctcagctcactgtaacctctgcctcctgggttcaagtaattctcctgtctcagcctcctgagtagctgagacaggcaagagaattgcttgggcacgggaggcggaggctgcagtgagctgagatcacgccactgtactccagcatgggcaacagagcaagactccatctcaaaaataaataaataaataaaagcgtaataggctccaaaactgttccaaattactcctaggctttttccccctaaaaattatgtgcattaggagaaaatgggaggaaaaatgaaatttctctatcttttctcattgatgaaaggttagagattgtgttgttgtaaaatacccttttgctctgggccccaagccaaaaataaagggaggaaaccaggcaattagatgtttgatttgatgaaaacttttccttaaaaaggcgaagaatttctgttacatgattttatacaagattatgacaaaggcattttcaaagaaaacatttctatctaattaaaatccattgatcacacatgctcctattaggttaaggataactccttggccttcctccctcaagagctttctggatttcttcagtaattacattaaaaagaatcgaagaagcccaggcgtggtggctcacgcctgtaatgccagcactttgggaggccgaggtgggcagatcacaaggtaaggagatcgagaccatcctggctaacatggtgaaaccccgtctctactc

SEQ ID NO: 39412 - DNA, 1150 bp, Homo sapiens
ggtcgacagccttctgagtaggactacaggtgcacacgagcatgtccagctaattaaaaaaaaattttttttagagattgggtcttactgtgttgctcagcctggtcttgaactcctggccttgagaagtcttcctgcatcagcctcccatagtgctgggattacaggtgtgagccactgtgcctggcctcttcttttgatccctcatccctattctcattcctctccctgtgtcagtatatgtttggatatgtatgtatctttgaaaatatatgtaattatgtgcctatgtgttttaatatatataaatggtatacttttatggtaagccaacttctgtaatgaattgctcccatatttcagtgatttaacaccacagatttatttttaacttattctacatggcacgggtgtttctggttggacagctctcctccactgtccactccagctcccaggcttcttttattttcagatggtgatagcctcatcccagcatcataaagtttccggtcaatttttcaccaagttgttttactatccgttgattatcattttatgaattgcttgtttcactagggattacagaatggtgattttctaaggctattaatttttcctcatttattagctctaattctgtacagaaaacctttttcacatcctctaggaccatttgattactccgaaataaaattcataccagaatggcaagataaatgcttaaatctcttcccttaccgttttcaaagtagttatgtcctaacaacttctaatggtgttcaatgatttttttgtttcactctctttttaaatgatctcaaacaacctgtagttcttatgcatttaatgtcgtttaatcatttgccattattttttgctttatattatataaagtatcaagcatatacaaaaatagagaaaatagtgtaatgaattcccagggacccagcttcaataattatcaattcatggccaatcttggtttatttattccctcaactactttccccctaaccaagattattttgaagcaaaaccagatatcataccaatttaatctgtaaatgttttagcatgtatctctaaaagataaggatttttattaccattattgcacctaaaaagttaataaattgtcagtataata

SEQ ID NO: 39413 - DNA, 382 bp, Homo sapiens
  misc_feature (91)..(91): n is a, c, g, or t
aaaaaaaaaaaaaaaagttaaagagaactgaagcttcaagaaattaagaaatttgtccaagtcacacaagcaagtgtatggcagagcaggnacataaaccctgcttatatgattccaaaaactttatccttaagtaataatagatgctgtaaattataaacattgagttaaatgaagtaatgaaggataagttactcagcgtttgttttgtaaagtctctcaaggaaaaaattaatctaagttggaggcactgatggcagctgctgcattcatgagactgtagcagtaatctaggagatgaacatagagggtggatttaggatattataaagtagtaaaatcaatagaactggatgatagattatgtgacgcctgaagtgga

SEQ ID NO: 39414 - DNA, 438 bp, Homo sapiens
gcttgacatgaactggaccatgctttcctggtgaacagggttactttgtccttcactttctgtgatgacacccagaaggttctcctttgtatcttgttcccttgtaataagcacatctgtgcaggtccccaaaccttctacagtaatttcctattgctgctgtaagaaatcacacacttactagctcaaaagaacacaaatttactacattagagttctataggtcagaaatctcaatggaccaaaaccacgctgtctgccaagagactctagtttcttgcctgttctgtctcctggaggctgctcaaattccttggcctgtggatcactttgacctctgcttacatcatcacatcttctgtgaccctcttgcctccctcttgtaaggacccttgtgattatattggctcacctagataatcaaaggcattgatcaac

SEQ ID NO: 39415 - DNA, 415 bp, Homo sapiens
tgtcagtgggtggcggtcacctagtttttgaggagatgcaacaaataagaccccctgtccctgcatttcccggaagtgagttctgaatgaactgagaaatgaagcaagagtcaagcagaaggggccagacagcgcctttgtcacccgcagagctgggattgcaggcgagccagcgtcctgatactgcccaggccatggccgatgcactgcccatgcaggcagcattaacacggtccagcctgtggctggagggcaggaggaggagcacacccacgggggcagcccagcgctccgccctctcctcccagactccccatgaccctgctcatgcctctcccaggcaggagcatccctctgcagaggtcctgtacgctcacagcacatgttccgtgttatttggggattgaagattctc

SEQ ID NO: 39416 - DNA, 336 bp, Homo sapiens
ttttttaaataaggtaacattaacaggggccaagtattaggacatggacacatcctttttggggccaactttcgaccaactataagaggtgtcactattataatataaatgcagattttgtagtattttaataacaactaaggaattgagaggagtatgtcttgattagagtttccatgtctagatctctattctttaaaagaataaacttttacaaaatgctagttcccctagaaacccccctcaaacctttggcctattagaatttcagagcaagaggggcatgtgatgcaaaggcacatgtactttgaaaatgccctccaagtgaacatgata

SEQ ID NO: 39417 - DNA, 368 bp, Homo sapiens
ttttttaaacttctctatattaggaactttgttttccttatccaaatgcagtctctaagggatcagtgggatttgagtgctaagttaaatgtctagtaaaaaattaaacaaaagaattcaagcaatcaaaatgatgcctgcatttgctgcctacagaaatgtaggctgcattgcatgtgtaaatggcaagaaaatttgggcgttagctaaccctttatatactgcttttctcaaactcatccaaacatgacagcttgtaaaaccgtttatatatttaaggtgtattagaccaagcctaggcacatgtaccagcctgtccatttgaagaggagtttaaggcagaacataccctttctaatttcattagt

SEQ ID NO: 39418 - DNA, 274 bp, Homo sapiens
cccatcatgtttctttacttgaattgactatttttccctttgtaattaataagtgtcttgcagcagctttccagaggctgtgtaaatatccttagtataggaccttttggtcatggaagctatgcagcccaagagtccaatcagaagtgatggaagaccaggtgtggtggctcatgcctgtaatcccaatgctttaggaggctgaggcgagaggatcgcttgaggtcgggagttcaagatcagcctgggcaatatagtaagacacccctctcta

SEQ ID NO: 39419 - DNA, 217 bp, Homo sapiens
cagaccaggaaccatgagaactgtactatgtgttggagcaaatcctttctgatatttcagatttctggttctgttggaacaagacacattctgagaaaagcttggtctactggtactggggcagaggatctgagcaacagagacggggcagcaccaagcctgacaatgcggaccaagtcaaacgaaacacagaccaccgagactattctttcagacg

SEQ ID NO: 39420 - DNA, 529 bp, Homo sapiens
tggcactggaaacacagtgggcgagtgactctgtggatgactccccaaaaaccaagcacctggtttgagttcagagctctcaaacatctgatgccagctcttcacattgtagatgaagcaaataccaggctcaaggtcaagtatacgatgcattactaaacccaagagtccccttggggagtagaaggaacaattctccccacctctgcaagatctccccaagacactctcaggctgtggcaggcagtcactgatgggtccagatgtggctggagcaggggggctctgggctccttgctagtcaggtctttgttagcagtggcccaggggtactgatgactcctgggagcttccgccaggaagctcatggggaagcacagacattctggggtacgaagccttggtggtcagacagggcttgtttcctgcagggcacttcctcagtcatgaatgagagtgtcatttcaccactctcttccgccataatggcttcatccagctcttgggacagcttctggagatgccgaat

SEQ ID NO: 39421 - DNA, 373 bp, Homo sapiens
tttttttttttttgagacagagtttcactctttgttgcccaggctggagtgcagtggcacaatcccagctcactgcaacctccacctcctgggttcaaatgattctcccgtctcagcctcccaagtagctgagattacaggcatgcaccaccacacccagctgacttttgtatttttagtagctggtctcaaactcctgacctcaggtgattcacccgccttggactcccaaagtgctgggattacaggcgtgagccaccacacctggccaaaaaataataataatttgttttaaaagaaggaaataacaagaagcctagcacaatacctggtggagtacaagtgctaggctgaataaactactgtaattata

SEQ ID NO: 39422 - DNA, 863 bp, Homo sapiens
actccagagcctcagatctccaaactcttatctagccccaaagtacaggtctgaccacaggagggagcagcaccgcggctccagcatgccccaggcccggagcctgtgcctccctgtctcagtgcggggtgggcgcgttgagctgctttttttggagcaacttatttcgagaattattttaatccttaaattccatatttcttcagcttccctttgaaaaaaaaaagggaaatttgtgtttttaaaaagtgttagttagtatttttgtcctttccaaaacatattcacttgtgcttactgttgtgagacacacatgtatttttctagttcccatctattattccttgctgtctgtttctgacctgaaaagcagcttccagtgaagagctatcactagaggaacaggacttggctgaatgaattaggttttattgagtttttaatttaatgtgggtaaagcaggctcaggagggctgaaatggacgaaacaatggcacaactttattacttttctccagggtatggattataggggatattttagagtaaagaaacactaagattcttggcattaaaatgcttcgatttcctatttatagcagtgatgcatatataatttttcatattggactgttattaaggtttttctgattgaaatctccgtacggtttcttctggccagtagacttcctccatccccagatgtgaccccttttaaactaataaagcctcttgataatacttacaatacttgtcacagagggcaggactgacattcacttagtgaagggcttgtattataccaggctttgctctatgtaagttttatattttcaggaatattcttaaatcccttaaagaaa

SEQ ID NO: 39423 - DNA, 394 bp, Homo sapiens
ctttaatttataaatataatgcacaaaattagtagatttcctaattgtgaattattcctgtgtgaattctggaagtaaatcctacttatttttgctaacattttgttcaggattttcactcctcacatgtggggccgctttacagtttcctgcttgtatgctgtcagcgtttgcagccagcctttcactaagcattgcaggaccagcctgtggggagtttccggaatcttccatgccctggagctttgataacacaggaagtgtttgttccttgaaaggttactagaagccttccataacatcttccaatactggtgcatttagggaaaacagatttttgacattttcaatttcttgcatgatgaaaccagtacaatgcatagctttcttgcaa

SEQ ID NO: 39424 - DNA, 1285 bp, Homo sapiens
taggcaggcactgcccaacaccatagggggtgctgcgggcctgtaggcttggttggcccaattactgccctaatgccatcggacagtgcccaccagggactctctgtcttgccaaggaaggccttaggcactgggctttagacatttcaaagtgagttctcattcacttgtgtctccgatcacactagagtccccatttcacagacaaactgcccagagtttgtcataggtcacacagcaaaccagcaactaagccccctggtcccctaatctgccccagaaaggtagtttctcagctgttctgagcttgacagcatgaacatcctcaggagccacaggcaaagtgggctgaggcttggcattcccctcgaggtcatctggccattctgaacgcccctcctcagcctgcttcctccggctgagccatgtgcccccggaacccctctgaactctgttgccgatccctccctccatctgcgccttcagtgaagcagtttcttaaaggaggggtccttggtaccgtggagggacaggacatctctgggaattcgtacccagctgcgttcgtgctgagttcttcatgacccactccttccagcgtcagctggtggatccagggctgggtactgagccgtactggaccagtgggccccctcccgggatcgctggacttggagcagaagagtccctccagggctgaagattggacacagaaaacttgggaactgtcaactgccctgttattcacctcgtgaaaaaagctggatttctaatgagagcgaatggaggtgacaattcccagaaactggaattgggatggtgagattttagttcagccgccggcggtctcatgcgtggaggtgataaagttgagctttgaggtggtcttcagagggagaggaataccctctgcgggcagagcttcctgggttccgggcccttccggacgtcaacacaggtccaaatgcccttgggctcctccgcacaccctgggtgcaagaataaatccttctctctgccgccattagcctgactggcttcggttacttcgcacaaaaagcccttgccgggtatccactcgccgctcgcagccctcgctctagctccagctcctgttccttttcctgcccaccccgcccagtgaggagatcagcaccccttgtctgtctctgtgtctgtcggggttcgtgcctcactgtgtccaagcccggcttctatccctagtcccttcctgttcgcgccactcctgcttgctttcttctccccttccctccagcggtggttc

SEQ ID NO: 39425 - DNA, 248 bp, Homo sapiens
aagtctgaactttgagtttgggggctggccatctagatctaaagaaagcctccaggcacagtgggactctcaggactccacctagacccagcctctctcttaggacttacaaagctcttcctttgagacaatttcaaaatgttttggtgcatttttcctggatggcattttaacttgacactgagatattagaggtgggggctgtgtaatatctgccatgttattctctacccctagcttcttgtgca

SEQ ID NO: 39426 - DNA, 362 bp, Homo sapiens
ttctggataaaccgtttaaaaagaatgttttggggttagcagtttgcatatttacatttagaatactaattaaacagtaccctacaggatataactcatagagagagcaacagaaagacatgtaaataactactaaacacactcaggatatattaataaaaaagctttctaaattatttaaggtaccaagaaagaagctggacaaaaattacggctgggtgcagtggctcacgcctgtgatcccagtactttgagaggccaaggcgggtggatcgcttgagcctaggagttcaagaccagcctggacaacatggcgaaaccccatctctactaaaaatgcagaaaaaaaaaaattagccagg

SEQ ID NO: 39427 - DNA, 475 bp, Homo sapiens
aacttgtgtcatgggagttcgttgtacagattatttcatcatccaggtattaagcctgctacccatttgtttttttcctgatcctctccgtcctcccattctccactctgtgataggccccagtgtgtgttgttcctctctatgtgtccatgtgttctcatcatttagctaccacttataagtgagagcatgtggtatttggttttccattcctgtgttagtttactgaggataatggcctccagctccaaccatgtccctgcaaaggacatgatcttgttcttttttacgtctgcaaggttctctgcttataaggacaaaggggagaatagggattggtgggcaactagtcatctactagttagcttagtaagctaagcattaaatctaagaaatagcaaaataagcctatggaaattaggaagaaggaaagaatcaaggtaaaagaaaaaataaattaatttggaaaaaaaaa

SEQ ID NO: 39428 - DNA, 192 bp, Homo sapiens
  misc_feature (1)..(1): n is a, c, g, or t
  misc_feature (63)..(63): n is a, c, g, or t
ntccaatccaatattcggtccaactttttccccggacacaccccacccctccatgatgcaccntatgcaaccgaggatggacttatacacacaaatgaccaggccaggactctacccaaagaatgggtttgtatttaagggccccagcagttagaacatcctcagaaaagaaggtaaggctttatgatgtgc

SEQ ID NO: 39429 - DNA, 3394 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39430 - DNA, 2618 bp, Homo sapiens
  misc_feature (1051)..(1051): n is a, c, g, or t
ctctatttctttggtttggaggtggagtatgaaggtaatgaggggaatactgtgtacttagtgaaatgatatatttctacttttgctacaaaagtccacatttagtgatatgttcagaattgtataaaagtggcagctttagggataatatccctcacagatagtgatacattgttacaggtagacactaactgtttaagtgttttgtgttgtgtgtggtgtacacctcacagtgtatttgacaaaaatgagtatcatgctttccctgctggaatgcatgaatccctttctccattacttctcaaacttgcatgtacttctgaatcacttgaagattcagttcagatgaagattcatatttattaggtctggggtgagctggattctgcatttctaacgagcttcccagtgatgccattgctgatctgcagaaagcaggggagtagcacagctctaaattacttctgttttgctttgagtacaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39431 - DNA, 3655 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39432 - DNA, 3545 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39433 - DNA, 1717 bp, Homo sapiens
  misc_feature (46)..(47): n is a, c, g, or t
gcgaagtgttggtgtattgagcgataatggggtggggggatgggtnntataactctatcgtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39434 - DNA, 1708 bp, Homo sapiens
  misc_feature (26)..(26): n is a, c, g, or t
catcccacccaccataaacacacccncgtcacacacccacccccctttgtttatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39435 - DNA, 1601 bp, Homo sapiens
tacgacaaacatatacagtctgcggggtgtctaatgagaaccagacaacgttaatgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39436 - DNA, 2565 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaa

SEQ ID NO: 39437 - DNA, 2627 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtc

SEQ ID NO: 39438 - DNA, 2517 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtc

SEQ ID NO: 39439 - DNA, 2675 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaa

SEQ ID NO: 39440 - DNA, 2191 bp, Homo sapiens
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgtaagtttttcttgggtcttggcgctattctacgctatatgctggtaggtgcttaagctgctttcgtaactttctgtgcccctggttctttctgaggcaggtgaggtggttatataaggctctcccatctgtaatcagtagtacctggtaatcatttaagaccttggttgtggacacccataattagagatgctacaaatacctcctttcaaattatattcctgcttttccagtgataagcacttgatttctgaagcttagtgtgctccagataagcactgactctgggaggcaacctggctatatagataattttagtacgcatttaaaggcaaaataaaagtatggctggattctttttattttattttttaaaacgtattaacctttaagaagggcagtttgatgcacatgttgcatttaactttttgagcatcaagtatttttttaacatttttgagcatttctgttgctctccaggatatctggaatgagcaagtgagcaaaaacaaa

SEQ ID NO: 39441 - DNA, 1375 bp, Homo sapiens
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggttggttttaaaaacaagtatgttgtacctttgcattaatttctgttctttatctctgaaaatagtcctacattgctcattatgttaaaataaaactggcaaaatactaaaagtg

SEQ ID NO: 39442 - DNA, 3450 bp, Homo sapiens
  misc_feature (1883)..(1883): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtgtatcctttaaatcattactcaagaatcatttgaaaagatagttccagaaaagagcctccctctgttacccaggctggagtgaaatggcgtgatctcggctcactgcaaccttcgcctcctgggttcaagcgattctcctgcctcagccgcccagatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39443 - DNA, 3504 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39444 - DNA, 3450 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggatatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggctatttctctaagttactcatattgtcctttgcttgaatgcaatgccgtgcagatttatgtggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaatgttt

SEQ ID NO: 39445 - DNA, 2366 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtc

SEQ ID NO: 39446 - DNA, 2968 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcactcgggataatgcctttggggccgttatgcaaacgacggacagtgcacacagctacatgtcatgtcagttttatctaatacaggatccacctgggacaacccagttataattactggagaataaggatgagatcgtttcggccagcaagactgtcttagtaatccgcattaccggatatacaggcgtggcgaggtcgctacgcgt

SEQ ID NO: 39447 - DNA, 2112 bp, Homo sapiens
  misc_feature (1827)..(1827): n is a, c, g, or t
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgttcgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaantacacagcgtactatcccaggtaaggctctgacagaggtggaaatgaggggcagaaacaaaggactcctttgatagccagtgcaagagctcacaaaagaatattgtctgccatgttgaaggttagcgtggcaggccacagcctctggtcatatctctgaccaagaaggttgtttcaagacaaagcaaaagcagtatagtttttaaccatatactgacagcatgatcttttaggtcacctatgtctacagctttccttttttacctctcctgtcataggaccccaa

SEQ ID NO: 39448 - DNA, 689 bp, Homo sapiens
cccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtgtatcctttaaatcattactcaagaatcatttgaaaagatagttccagaaaaggtaattcaagaaactttcaaacattttaaattttgtcagcatatggataaaattggcctatccaaaatttgtttactctgctgagaaactaaaatacaattatagacatctttgaaagt

SEQ ID NO: 39449 - DNA, 408 bp, Homo sapiens
tcccagtgggggtcagggcgtgactggcctgagaggcagctctgccccatgggaggccattgaggacaggagctgggagaggagtgagtaggcccagccttgtgtcttggccctgccccataagccagagactggtggaagtaggctaaggaggatgaggggaagtccccagggaaagggacctttatacgatcccctccaatgagcccctgctgggccccatagatgaacccctgggctgaggcctggcgtgcgtctggctcaaagcagagtgtccccaaagccagctgactctcagaactctgcagctgtaaccaggccccactcacacagtatgacctgtgctcacacacctgtgctaggacgaaagcactttccactcctgccggctggcacacaggaggccca

SEQ ID NO: 39450 - DNA, 307 bp, Homo sapiens
tctcagactgttgccctgcatgaatcaagaatttggctagtgcctcgtgatgaaggtgctggctgtcaggcatacttcttctctaggctttctctcaaggaacttggcttctcaaaatcaacttattttgtcctaaaatccagtctttataccccaagtcctttgaggttgacaaagctctgctggattattggcctcttcactgcttggctacttcccatatccctatcactcccctccaacctacctagatgcagctaactaatagactgagggaaaacgtggcttgcagaatatgagcttattc

SEQ ID NO: 39451 - DNA, 302 bp, Homo sapiens
tctgggttagaagtacattatgttatttccaaacatttcaacattttctggatatcttttagttgtaaatttcttgttcagtttcactgagggcagataatacgttctatatgatttcaaacatttgaaatttgttgagacttgctttgtgtcccagcacttgttttctttctttcttcttttttttttttttttttttgagacagtgtctcgctgtgtcacccaggctggactgcagtggcatgatcacggttcattgtagctcaggagttcaaaaccagcttgggcaacttagtgagacc

SEQ ID NO: 39452 - DNA, 346 bp, Homo sapiens
aagaatcgcgtctcaaatgcaaggcctacacaagagtatttgtttcttgagctgaaagaagtgaccagaaaatttagtcacgttccttggccaaaggcatctacattaggaaaattaggtgctttctgcgtttctgggagaatgagttgatattggcatacaactaactttcttttggaagagtttccatggaaaggtggtcattagatgaaatggtagttccgtctttcctgcaacataactcttgggagcatctgagaggaaggttaggagatacttgctattcccaaaactcattctcatcagaaactttaatattccaaggtaagaattttcttattcagta

SEQ ID NO: 39453 - DNA, 244 bp, Homo sapiens
atcccatctctactaaaaatacaaaaattagctgggtatggtggtgggtgcctgtaatcccagctactggggaggcagcggcacaagaattgcttgaacccgggaggcggaggttgctgtgagccaagattgggccaccgcactccagcctggatgacagagtaagaatctgtctcaaagaaaaaatatatgtgtatatatatagtattaccacccaagggattattacacagccactaaaaaa

SEQ ID NO: 39454 - DNA, 430 bp, Homo sapiens
taaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagactttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgt

SEQ ID NO: 39455 - DNA, 782 bp, Homo sapiens
gaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgt

SEQ ID NO: 39456 - DNA, 918 bp, Homo sapiens
gaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaa

SEQ ID NO: 39457 - DNA, 379 bp, Homo sapiens
ggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagacccaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgc

SEQ ID NO: 39458 - DNA, 827 bp, Homo sapiens
gaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggaagagggggctatagacccaactctcgttatggaaatacttatggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgt

SEQ ID NO: 39459 - DNA, 354 bp, Homo sapiens
gctgcttgcaaatactgcatggcaagcccagtgctgtggggtgaagaaaactccctgctcttgacctagcaaccacgactacagtgacaactactattagtattaccacaatactactatattacaaccacagctgctacgattgccatataacaggtaactgtggtcatctcttgccctagaccaccaaaacacccttctacactactactctgcttctcctctcctctcacgccattgtccacccagcagccagaattcaccatttgaaacataagacatcacttgctagctcaaaattcatgtgacttcccatttcacttctagtaaaagccagcagcaatttttatgacc

SEQ ID NO: 39460 - DNA, 648 bp, Homo sapiens
cagcagcccaagcaacaaggggaataagattagccacaggtctggcatgttgcccagttgccaggcacttgctggcagcgagaaatttctcttgtgcatctcctacaaggactgcagtctgtgtagtagctgacaaactcacagcctcagaaacaggccaagggaaaaatgcaaaagcaagttccacatggctcagtggggaggctaatccgtatataaaaatatatctttatagctctgttcactgaaaaggccccgaaataatgattaagcctgtggcattgagcatccctagctcccagatgctggtctggagatgcagtttctcatggaaaccgacttcttggagaagtggctggctctgggtctgggcaggaagtgtatgagatgatcttggagcgcctgtcctggcagatggcaaggaggccatcagagactcctggggccatgtccagagccctcaggagccagcttgaagaggttccaccggccgcagagcttctatgatgacactagttgccatggatcgaaacccacccagtgtgtttaaatcagagctcataatggtattttttaaaaaagaacgtgtcatctttgaaggatgaaagggaaccgatgtattatgctgaaaactggtaaagaaagaaa

SEQ ID NO: 39461 - DNA, 498 bp, Homo sapiens
actaaaaatagaaaaattagctggcgtgcatctgtagtcccagctgctggggaggctgaggcaggagaatcgcttgaatctgggaggcggaggttgcagtgagccatgatcggaccactgcactccagccagggtgacagagcaacactatgtctcaaacaaacaaaaacacgacaacaaaataaagcttaaggaacatcaaccaaatgcaatatatgagccctatttaggatactataaaaagacattcacaataacacaggcaaaatgaacataaactaggtataggtgacagagaaatccaataaacattgaattattcactggggaaagaaatgatgtgtgggatttaagtctctaactctcccctatttacgccaaaagattgtccatgagttgaaaacttagagatgggtgacaacgcaagagagattatagtgtcttccttgtatgcttgtaaatgtcaaaaataaaagtaatttaaaactaaaacaaaca

SEQ ID NO: 39462 - DNA, 353 bp, Homo sapiens
gagcaccaatttgagctaattctggaaaaaaaaattctgaaatatatagaatcctgtagccttaataatgataaatcttctaagtgataaaactttaaaataagtaccactagtgacaagcagaattatttttattaaaaaattttatccatcttattcctttttaccaactcacattgtactctttaataaaccttattaaggaagcactagtatattacattagctaggtgtaattttcacacataaattatatatgctgtattcagcaaggccagatttctattcaaacttaaccctctgaagtaaagttgtaaaactggaaatcaatgaaaaagacctataaagaactg

SEQ ID NO: 39463 - DNA, 607 bp, Homo sapiens
gattcgagctccgtacccaagcccttgtcaatgggaccaaccccccttctctttgcccttcctaacttaatccctttttttttttcctcctcagatgattcatactttccttgcccttattatgtctgcagtcagttcttaactctcttctgactagtttggtttttttcaccttctatatcttccgattgctcctccaattcctctcacactttgcgcttctcataccctatgtcctgaactgctctctgcaacccaccaaccccagtcctgaactgtgcatcaccagcgtctctgacccactgccacaaacctggtcattctactcttctctaccagaggacaggggagaagcaaaaaggagcaaagtatgtgagaggcaaggaagctaagcagagctaagaagcacctaagaggctcacaacatattagtcctgaaaaaggtttgtggcagaccactgaattcaaaggcatctaacttggtatgtccacgctggctctcctcagtattccagcccatttccatgaggtccaaccatgttccacttccagtgttccctattgcaagatgagaccatgactggctgcccaagccagaaatctgagg

SEQ ID NO: 39464 - DNA, 554 bp, Homo sapiens
catggacggggtatgaggaagcggatattgtcacattctcagcctgttgcggctagtgagttacatggagcgggcgctcccggaagatgctagtaaaactcggattagtgactgagtgtttttggaagttcttcctggcactgtgtagctagtttcaatgacttcaaagtggttataggaaggacatggtagcgagctgatagaacatattggtgaatgcttttacaagtaaatcagatcagctctgcttcctgagggatggggatgaaatgatttctcactgtgctgagcagtttagatctggaacatgacggccatcagtttagtggcagaagtgcatggtgatgatgctctgtttacacatctgttccattaatttgtatttattcactcattcaacaaatatatattgggctctcctataggtcaacttcagggctatattttttgtttctgatgaggggagcaaatatacagaagtgaataatatatggaccttgcctttgaggagctcggagcctaataaagaggttcccaaactttctcaacttata

SEQ ID NO: 39465 - DNA, 360 bp, Homo sapiens
ggcactggattcaggcactggagggatggccttgggcacactgtgtacacgtgaaagaggatttgtggggaagaaaaaagcagaaaagagaaagatgctatcaagaactatgggtggggatgcagggcagaattggttaaggaactggtttgtgctacagatacaggctcaggcagcgctatgttctgacttattcctgtgttcacacaatcagaagagattatgatcaggtagtccaagaaacctgggttggtgaaaaaaacaggttcccgatagagattcattgtctacagtttagataagccaggagtcttctaggcacctgtgtatgttctcggcagaaatctctaggaggaaagc

SEQ ID NO: 39466 - DNA, 1307 bp, Homo sapiens
gtttggttttctgtgtctttcagggtgagactggtgtattctataccagcctccctgtgtgtgaacaatgacgagaacaatgttgtcttgctttcccaaaaaataagacactatctatttctcattagttatacacgttcattataaaacgtaatttaagcaatactgaaatgccaaaaagaaagtaaaattcactccaaaagtaaaattcaccccaaatctcactactcctgtaactatgtctgacagccagctgttgggtcttccatcgtttttaaccttcaggtgagcacacagatccttattttttcttttcttttcttttttttttttttttttggaaacgcagccggggcaaaagagggaagattcttgaccaaaaaaagaaatttgggacaggttccaagggcttgagaaggtattttatgtgtggccagggggataaagacgcttgggtgagaagggcgtataaaaagacataaaaactatatggaaagattgcccttttatatacgtgctaagataaagctgtgcgtggaaaaccaaaagaaaggttgtttactcggcggcatacgagggggaacatgtggagaaattaactaagataatacacatatgttgaaaattcaaaaatataagggggttaacattgcgcgtctggcgtaaaggtggaaccgcacaatacacaaccgatacgtgcccacaaaacaccctggcccaaaacgggtgattcaccaccgcggaaaacacccggaggggcaaaaaagcgggagcaacaaacttcaaaaacaaaccgaggatctggacctttggcacacatcaaatcacaagggcaggacacataaaaaagttgcggggaagaaccacaagacacccaatagggaaataaccagacgggacacaccacaagataaaggcagcactaggagaaaagggcactaaaacacacaacagtctcttacacaccaggggcacaactaaaaacccgccgctacataaaaagataacagagccacaacaaacgggacaatagtgaccccagaaaaacaaaaaaacagcgcgcgcgcaaaaaaaaaccacccaagaggcccaaacaagcgaccccgcactgtgccaaacatgccacaaacgacaaaatacaacaaacacgaggaacaacagacgacagacaaacaacagaagacgaagaacaaacaccgtgaacgagaaacaaaacacacaaagaagaaacgcgactaagaacagcagaaacagagtgaacaacagaaaacaagaacgacacaaaccaaaacagacctcaaaggacc

SEQ ID NO: 39467 - DNA, 334 bp, Homo sapiens
cctggactgcttatccaacaaccagtgtagttgacctcagagaataatccaaaaaagtggtaagggctgaatcaagcttaataagtggcctacctcttgcatctgcaagatttgtcttgggaacactgtatgacacaactgtggctgcagttgcagctgaactgttatggttcagaatgttccaaagctcaggtcttcctcttcttaactgtctgccattcttctttccttgaattatctttctttaagctctttattcatttttctttttatcctctcacctttcacttttctgcctatgaggaaagacaaaaaacaataaaaggaagccttg

SEQ ID NO: 39468 - DNA, 261 bp, Homo sapiens
gtcctgtctccataaattctttattaattgctctggtgtgtggccagagcaatttcttcagatattctgaagttcagccagggttgagaaccactgccctaaggcctgttctcaacgccttaagtagttttactgcaaaggcttctgtgtccctgggtcagccacaagtatcaagtcacataagaggactgaacagtgatacaggagactccggtttgatttccagccctcttgctgactagttgtgtaactttggataca

SEQ ID NO: 39469 - DNA, 378 bp, Homo sapiens
ccaggatggtcttgatctcctgaccttgtgatctgcccgcctcagcctcccaaagtgctgggattacaggcgtgagccaacgctcctggcctggctagggaaatattaataaaatggcagaggtggagacagatgttaaagaagtggaggcattgggtgctattttgagaagcattgctctgaaggaaagaagggagaagacagtagtttgtacaggaagcaaggttgttgggagagagttctccacggatatctcacatttcttcatgtttcatgagtaaggcactgactgcctttgttctagactgttttctcaaggatgtttatatagtgagcacccttgaaagacagagatagtatctccctccacagctcaaa

SEQ ID NO: 39470 - DNA, 179 bp, Homo sapiens
atgggcttaatcagtatttattaatgattcatttctgtgctgtccaatatagtaaccactggtcacatgtggcttttgatcatttgcaacacggctagtccaaatgagatgtattgcaagtgtaaaatacattttgaagtctcactataataaaagaatgtaaaatgtcttaatgatac

SEQ ID NO: 39471 - DNA, 147 bp, Homo sapiens
ccttcctgtgtctcagtggggccatggccagcgcctcagggtctgagaagcctgccctgaccaggggtgccttcttcagatgacccaccatggggacaaaatctctgcttctcctggactgaattgggagccacgaggagaaccagt

SEQ ID NO: 39472 - DNA, 340 bp, Homo sapiens
gcgcgcgcacgtttgtttttgtataccccatctgaccacaacagctgttgggtttgtggcacttcactccagactaaaagataagtttgtctgtacctggcctctcaaaaacgtcatttggaaagttgtttcctaatatgaggggttgggggaagggagcagcggaagacgaggagagggtgccccctttctgtaacttcccagctacagcagagacagacaaatctcacactgtaagccgagacaggctggggattatctggctcactcctgatttaatacatgaagaaatgaagcctcagagaagcccagagcttgccctaagccagacagctgaacc

SEQ ID NO: 39473 - DNA, 450 bp, Homo sapiens
ctaatgtaatgtaaatgctatgtaaatagttgctttactatattctttagggaataatgacaagaaaaaaagtctgtgcatgttcagtacagatgcaatttcttgtttttctaatattttctatccactgttggttgaatccatgcatgtggagtcaacctatggatggggatggcagactgtactctcctgacaggtggttacaaagtatttctatctgaaaagagctggctgcaaagcagcatgcccagtataactttcctcaggcccagggaaaagcttggagggaggttcccacagaaacattagcagtggtttcctgggccagtgggataaggaccaggcattgtgctagcagtggagaaacagtggtgaataaggtaggtctggctctgtctcctggagcttactggactgaagatgaacctttctccactaatttttattctg

SEQ ID NO: 39474 - DNA, 169 bp, Homo sapiens
ccatatttgtgatcttttagttcatgggttaaatcatttggcagttactttttctttaaaatcaactttattgaaataaaatctatatacaataaaagtcactttttaaaagtaaaaaattcaatgagctgtgatagatataaactatcaccacaggtataaccatctc

SEQ ID NO: 39475 - DNA, 1047 bp, Homo sapiens
ttctccattgccatgtatcaaaccattccaaaacgtgtggttaaaacagtattctcataattctctgggttaacaggactcagctagatgtctttagtgtcatgtggtaccagcaagggccactcatgagggtgcgttcagctgggagtctggcggggttgaaaccttcaagagacacaagtctgggcttttagtgctgtgactagagcaccttggttctcctatgcatcgtctctcaccattcagtaatttagcccaagcttctcgtttggaaacgtgtcagcttattttcaagagcaaaagtggaagctgccaaaatatcacttccatatcctattagtcaaaacaagtcacaagttcagccctcactgtagaaaaaaatagaccttattggaaatagcacgtgcacagaggatgagagcaactgttggtggccatctttggagatgatctaccacacctctaaatttgtgagataagagtgtaggtttctgataactttggaattgaatgtatggtaagctgtttgcagaaacaaatgtccaattaagaacaaagactggtttcttggaatgaacatgacttgtcgaggataaagatgtttatatctcacatggaacatttgtgaggagccatggagccagagttgtacaatagtacaggttattttctccattcttgggcacaagtaaacaaatccgcaaacccccaaatggtaacaacatgacctggacttaaaggtattgcacaagaggttaggggcaaactgatgttttggcaccagggacatttctcatcgctgggcaatcctttgtttccttcttggtgacattcattgggattttgttgcagataccacacaggaagaaggctattaaactgcccctatcagcaggaaacagtctggaggaggcagtcacacataattttgtgaaagaaagtgctgaggcaaaaccagctgaggtccgattccatgatcccaatgaacagcaaagcaaagggtggcttctagaagtcctagcacacatcacatactatcattcagca

SEQ ID NO: 39476 - DNA, 940 bp, Homo sapiens
taggcactcggctttataaatacatatggttgatgtacttaagttagcctgcaaagactgagattcttgaactgtaagtcaagttgtatcagtggtaggtcattgttgatgtaacagtaactgcataaagatgaatatagctactttaacagtttcatagcatttatagcacatggtcctttgaaactctgttagtgttaggtgaattgattatcactgaaaatatcatgccactgtggttgcttgtaaagttttgtgtcgaagttttaaaaatttggggatgctagaaagtttgataaatctgctttgaattttgtctattttgtaggcaaaatactgttttctcagtaagaccaaatgagataatacatataaaagttcttcataaatggtaagaaagcatgcagatattaagttgttgagataggtaactaattaatacatggacagaagcttctgtctttaaatgctaactttttccatatcagttgagaaagtaatacatttaaagtgcaccctggacactatagtttttttatttttttattttttgagacggagtctcgctctgtttcccaggctggagtgcaacggcgtgatctcggctcactgcaacctctgcctcccaggttcaagcgattctcctgcctctcagcctcctgagtagctgtgattatagaggtgtccgccactacgcccggctaagttttgtattttgagtagagacggggtatcaccatgttggtcaggctggtcttgaactcctgactcaggtgatccacctgccttggcctcccaaagtgctgggattataggcgtgagccaccacgcccggcctaaatttttgttttttaaatactgctgtggttaccaaaaatgtctttgttatagttttgaagctgcttttgaaaaaatgctgcctagtcagtttctcataatt

SEQ ID NO: 39477 - DNA, 252 bp, Homo sapiens
gagtcagaacagaaaaaaatagagtaattacagttgtgatgttgtaaaccagagtggcccatagacccctgggggtccctgacaccctttcagaggatctttgagatcaaaattattttcataatacttctaagatgatacttgcttatttcacagtgttgacatttgcactgataatacaaatgcaatggtgaacaaaactgctagtgtcgagacagtgggaccaaagtgtactaatagtattgtattaaa

SEQ ID NO: 39478 - DNA, 415 bp, Homo sapiens
ctcccctaattgctgctttcccagccactcccattgtgcccatcgcccgagagcatttcaggatcatttctctcccctgggaagtgcttgtagtgagaaacagagagtgaagctgtttatcacaataccccaggcttaaccctggaaagatatttcacttggtttcaggccttttgaaaaaaggagagtgctaactctcttaacagagcttttgttcggttagaaaaacaaaacaaaaaaccaaccccaaacaattattttaaaaataaataattaaataaataaaggcttggcgaagtggctcctgcctataatcccagcactttagaaggccaaggtgggtggattacttgagcccaggagttcaagaccagcctgggcaacgtggtaaaatcccacctctactaaaaaacaa

SEQ ID NO: 39479 - DNA, 453 bp, Homo sapiens
tagggtcggcgtgggcaagtcatttctcttcctcaccaagccttcttccatttgaaaaggaagagatgatactacccaacttgcctgcaaatggattagccagggcaaactttgcaaatcaaatgcctttgcattcattaacgcctcccaggcagaacgtaccctccctagggcaatgaaatgttcccaaggtttatggagctcagaaactctcaagggagaagggcgggagtcctcaagaatttgtttcttgtttggtctcagaggagggcaactaagccccaagtgtggggagagctgctgttacaggccacaaggaaggatggctccagagaaaacacaagtgacagctgctgctgaacatgttttgaggaccttgggacaagtttcactgcctctgtggggaaggggaacaaagttcttgattttcctctgagactcaaagaaaatttg

SEQ ID NO: 39480 - DNA, 1249 bp, Homo sapiens
agaaagagtagtttttggtaccacagtggtattaggtaaacccaggaaaataatgtcagcacaaggtgagggtgtgctgatggattataatatcctttcttagagaatcaattaaacttgcttagggtcttttatcgattttggcttataactggactaggataggtcaaagtattcaaggagtagaggcatagctggctaaaaatagtgaagcaagtatggaatcctgtctttctgagatggctgtgaaatgttttagttttgatatactgcatgacttttacagaattaattggcattgtgattaggttgttttatttcttcactcaaacatgttggaagccgattctaatatgcggtagtaatgaaaatagagtaatgctgtaataatagtgccattgtaaagtgaattacaccattaagcatctattttgtctaatttgtattgtggtagtgtgagtgatacacacacatgcagacgtagaggagctggtctttaagaaatagactctagctgagaagagaaaccccagtcctataatattgaacagtcagtgaacaaaaataattggttctgtgcaaagtgaatttatttatacatatacatatatatacacagccacatatataaatatacacacacatgcacacatacatattgtgtcaggcagatcaagaagatatatgactttggcataaaaaaatgcttggcttatgttgccttttaacaagttgattatgaatggggacacatattaattatgacaagtcaagtcaatgatggcatcaatgccaggctttgaaaacaaggctttctacgtttgtttcaacctcttcatccttattaccatgtctgagaacccctattaactggtatttctcaagttttggaaagaagtattaagggcccaggaatgatcattttattttgtcatttatctcctaaggaaggacatttgtcaaacaattttctttccacagcagaaagatagaggcacatttctatgccttaagtcacacatgaaccctaagagcagaaataggacctgagaaggcagtgtccaacatggctgctcccagtgggacaggtagatttaaaagtacaagaagggccaggcgcggtggctcacacctgtaatcccagcactttgggaggctgaggcgggcggatcacgaggtcatgagttcgagaccatcctggctaacacggtgaaaccccatatctacctaaaatacaaaaaaaaaaaaa

SEQ ID NO: 39481 - DNA, 248 bp, Homo sapiens
  misc_feature (129)..(129): n is a, c, g, or t
  misc_feature (131)..(132): n is a, c, g, or t
gaaagaccgcttctctttctaacacagcctcactcccacacctgcccctggacaggacagcgcagagggcaactagggtgccccatttctgtgcacaaaggctgtccctaagctcaggtgggagattgnannggggatgcaacccctcaatgcctgttccttccatctggctaagcaagcggagaggcagggagaagttctgcttgtgatcactgctccaaagtcctttctcagactcatccctgctc

SEQ ID NO: 39482 - DNA, 292 bp, Homo sapiens
aggctgaagtgggaggatcacttgagtccgggaggcagaagttgcagtgaacagtgaccgtgccactgcactccagcctaggtgataaagcaagaccttgcctcaaacaaaaaaaaagcaaaccctgaaaagtctacatgcatattgaatgtttaaaaacatataaaatgaattagataaagcaaatatcttgaaagataaaactgtgaaaaattttatactaagaaatgagccaacttatttgacattgataaattatttcctagagaaaagtgtaattgaagtttgacta

SEQ ID NO: 39483 - DNA, 804 bp, Homo sapiens
ccatttcccccactcctcccctttctagcccctggcaaccaccattacattctccacttctgtgagtttgactattttagattccacatataagtgaaatcatacagtatgtgtttctctgtgtctggtttatttcgtgtagcataatgtccttcagattcattcatgttattgcaaatggcaggatttccttccttttatggcttaatagtattctactatatgtgtctatttgtgtgtgtaccaccttttccttttccattttttatatttgtaaatatgttttcatattcataaaagtaataatcttcataaaaattaattgaagtaaaagtcccacattaatgtgtatgcatatataatttttctatttaccctaatcaacctgacaagcacattggcatctattctataaatgtaaagatcttgtctctatttagttttgtttaaacacaactttaggaatctgtactgaagagttcagatcaatatgattagtttaatatagaaacagaagctattacgaagagaaaatattgataaattttgagccatttgcatacacaggaggaaaatatttgcttgtcaaggaattttaaaaatcaattattaaaattgtcagtacatttttacagcatatccttgtacttcatgggttctccaggtaagggacatccaaagaggtggacacatttataatatctcaagttttccagccaagttacatcagaatcacttttttatgcttcctcaacaaccaacatagcagcagcaacactcatttctttgaaaagatcatattta

SEQ ID NO: 39484 - DNA, 462 bp, Homo sapiens
tgagatggagtcccgttcagttgcccaggctgctggagtgcagtggtgatctcagctcactgcaacctccacctcccaggttcaagcgattctcctgcctcagcctcccgagtagctggattacaggctcccggcatcatgcctggctaattttttttgtatttttagtagagacggggtttcaccatgttggccaggctggtcttgaactcctgacctcaggtgatccatctgcctaggcctccaaaagttctggtattacaggcgtgagccaccgcacccagcccctttctttcttcttcacctgtagtgttgctctagtttcttgtagctcagcaactgggcagtgaaagaattggtttccctgaattatttgggggaatttatttatttcacagcagcaggaattatttatctagcctaggctgccagacacttctgagcatctagtcatttggaggt

SEQ ID NO: 39485 - DNA, 416 bp, Homo sapiens
gcacttacttgctttggaacttcgggcttttaaatctcgatttctttgtgtctcattttgctcatctgtaaggtgaaggtagcagtactgtgcttccccaggcagcttgcacaatcactgagctgccaactcggagttcttggagcagtgctgacagtgagcgcagtgttggtgtttacttgagtcatcgtcgtgtggtcatgatgacgagtcacaaagatttgagtcctatttggattttacttgtatctgacctgtttttcctttttctttttttttttatttgagacggagccttgctctgtcaccccagctggagtgtagtggtgcagtctcagcttactgcaacctccacctcctgggttcaagcggttctctcacgtcagcctccagagtagctgggattacaggcgtgt

SEQ ID NO: 39486 - DNA, 362 bp, Homo sapiens
tggtggacagagtctcactctgttgcccaggctggagtgcagtggcacgatctcggctcactgcaacctccgcctcctgggttcaaacaattctctgcctcagcctcccgagtagctgggattacaggcacccgccaccatgcccggctaatttttgtatttttagtagagatggagtttcaccatcttggccaggctggtcttgaatttctgacctcatgatccacctgcctcggccttccaaagtgctgggattacaggcgtgagccactgcacccggcctcaaagattcttttggctgttgttgtgtctcttgatgtttaatgaggaaactgaactaagtgctatggtcccttcatatc

SEQ ID NO: 39487 - DNA, 495 bp, Homo sapiens
gagtttcaccatgttggccaggctgcgaactcctgagctcaagtgatcctcccacctcagcttcccaaagtgctagcattacaggcatgagccaccacacctcaccagatttttaaaaaatatataactgcatctctcttgattctggggcttggtaaaaatggatagataagatagtattctaaattcaaattcgtggctaggcacagtggcccacacctgtaatcccagcactttgggattccaagacagaagactcacttgagtacagtatgagaccagcctgggcaacatagatcttgcctctacaaaaaaaaaaaaaaatagccaggtgtggcacatgcctgtagtctcagctgcttggaaggctgaaatgagaggatctcttgagcccaggaggtctaggccagagtgagctgtgatcgtgccattgcactccagactgagtgacagagtgagactgtgtctaaaaaaaaagtttgaattaaaaaaaaa

SEQ ID NO: 39488 - DNA, 327 bp, Homo sapiens
gaagctggtctaagagaggaagaaggaaggaaaggagacgccccctcttctgcccaacaatgcaaagaagttaagttgactagtgctggagctgggagccaaacccaggctggactcttaaccagctgatctaagagaggaagatggaaggaagggagaagctcccacttctgccccataatgcaaagaagttaagctgactagggctggagctgggaaccacagtcaggctgggcccgagttttaaccatgtctgcagggctgcctcccaaaaaggcagagagagaggcggaaaagggggatggagacagctgaagagagagggag

SEQ ID NO: 39489 - DNA, 298 bp, Homo sapiens
aagcacaccaaatggaagacaagttctcaatctagtctgaggatttaacttgtaacttggctttcaggcttcaaactgtcttcagctcggaggtagggtttcactgggggcccaccccagtctgcctaggtatttggctgactcctgtactcttgagagggatggcagatggcacgttgtttcagcatctgaaatataatgtggatgggcaactggaaagacaaaacagcagcagtggcatgaacagagcttagcacagaggggacaacacacaaatcgttgatgaatttttaaaatg

SEQ ID NO: 39490 - DNA, 250 bp, Homo sapiens
tccatgtagaacaaagaagagaataagaaaataatcatctggcaaccatcaaagtaataattgttcaaacacaagtcatccatgaaatgctaaatctagtgggttctgaggagttaccagatatttacagagcctcaaagtatctccatacaaaatacggttgaactacaaaaagaaaatcataacattagtatggacaaacctggcaggtactccttaagtctcctaagtaataaaaactgtaaaatgc

SEQ ID NO: 39491 - DNA, 423 bp, Homo sapiens
tttcacaattatgggcaatgccatattctatctttgtggaaaagctttttcagtatttaggattatttacttgggatcaagttccagaagttgaattactgagtcacggtttgtataaacaatttttagacatcctatacctatcatcaaattgctttctccaaagcactacctgtttcagcacaccttgtgaaagcactggacagcctcttttttataaagcttttctaatcacataagtaaaaaacagttatttcatatggttctatttgtaagtctttaattgctaatattatttccccaaatatgtattagacatttacatttgtggttcttagtcacctggccatatcatttatcaatttatttattcactctgtattccttgggcccacagaacacactgttctattccctgcatga

SEQ ID NO: 39492 - DNA, 455 bp, Homo sapiens
actgaggctgaagacggacagcccctagtgcctccttgacccccaagaaggaggccctcagcggaaggatgtgttttctcaagtccacagcttctgtgcctacatagtaggtgctcaataaatatcttatggatcccaggggttctaactgcaatctcctctcagtgcaatatatacattttcccttccctaaatgtaatgactggggcccagagtcagcaaatgattcacctgcgattacacagtgacttggttgcagagggagggctagaacccaggtctcctgcctccaaacccagggctctctccaccacccccaggtgggcctcctgccctcattgctaaaatcagagaagagggagcaaatctgtgagtctgggagtcagcaccgactcatttcctcttacaggatatttgtatttaaatctgtgtgccaggccaacgaagagaaatcg

SEQ ID NO: 39493 - DNA, 326 bp, Homo sapiens
tagaaggggcagaaattcaacaaactttgcctaatctgaaagagacttcagtagaataattactctacttgattcagtatgagaaaggaaggagttattttgtacactgcagatattcatgtagaccaaaatatcatctccatcattaagtgtaggtaatatttaggggttatctcattcatttccatttggtagtatagaatgcttagatgataccttattactctaaagcagtaagaatttcaacagatacaataataatcttatattaaaaattaatcatgggctgggcacagtggttcacgcctataattccagccttttgg

SEQ ID NO: 39494 - DNA, 353 bp, Homo sapiens
tgaaagagaatgttcttttaataaagcatatgttttctaatttacacttgagcaaacctttattttaaagaaaaattgagaaatttatgtttcagagttatgagacaccgtcttcttatctaagatatgaaggatgcagcaataaattatccagatgttttggctatagtctttttttattgttgagtaacaaatttccatacacttagcaacttaaaacaatatccttttttttttttaatgtcgcagctctttaggtcagaaattcaggataacagggctggtttatgtgctcagagtctcaaactcaaggctgaaattaaggtgctaaccagctgtgatcttatctggaa

SEQ ID NO: 39495 - DNA, 578 bp, Homo sapiens
acattgtataacaatcaatgtggcctttcttttggttgtatttttgcattagttttttttctgattgtaaagtgaaaatctctagcctcttaaaaggaattatcagcaccattagaagaagtagagtgatggttctattccagtccaatagctataacaatagtaatgataatagctgacatttatgtagcactatgggccaagcactttatatacatcatttcatttaatgctctcaacaatctataaggtagatataagtaatgtccacatcacatttcagatgaggaactagctccagtgcataatctgcctttaaaatttttacctaggagctaaagttattagatattacttcagcttcagtgggattcagactaaatagaagaaatattttaaatttcttctagcactactcaacctggaagtaatagcagctgtcatgacctatcactgtaatccattgtggtaggggtttagtaaaccctggatgaatggatggatggatgaatgggtagatggatgggtggatgggtggatgagtaaatgggtggatggatgatagataggtggataga

SEQ ID NO: 39496 - DNA, 502 bp, Homo sapiens
gtgtgggatgatagttcttgagagtcggggaggagagtgcagcattgttggggctggcattgtatccaccgaaaacattttcagcatctcttctcttctatacaagacttgtcctcttggtgtccctgtgggtcaccattaagtcgcttgcttattctttctcaccatgtatcttcatttacctttctctaaaacttctgtaatttgcttttatcaagagattttggtcgcgtgcagtggctcacacctgtaatcccagcactttgggagactgaggtgggcagatcacctgaggtcaggggttcaagaccagcctggccaacatggtgaaaccccatctctactaaaaatacaaaaattagccaggcatggtggcgagcacctgtaattccagctacttgggaggctgaggcaggaggatcgcttgaacccacgaggcagaggttgcagtgagccgagatcacaccattgcaccctgggcaacaagtgcaaaactccatct

SEQ ID NO: 39497 - DNA, 446 bp, Homo sapiens
tccaatcagagaagttttgttaggtaatgactacagatactaagggaggattatcactgagtattaattagctcctggctaagtgaaggagtttatcaatgtgagttttgctcatctctgtatgcttatccactgtgtccagagtcattctttaatattagccatataccctagtgtaacattatggttccatttgttttgtctttgtattccttttcaaaacgtgtatacctgattggcttttaatattggaactggccgggtgcagtggctcacgcctgtaatcccaccgctttgggaggccgaggcgggcaggtcacctgaggtcaggagtttgagaccagcttgaccaacgtggagaaaccctggctctactaaaaatacaaaattagccgggcgtggtgacgcatgtctgtaatcccagctgttcaggaggctgaggcagg

SEQ ID NO: 39498 - DNA, 293 bp, Homo sapiens
ggtcgacgaattgcacagcaacttgaactattacacacaaatacatattgctttgctgtggcaattaaaagcccagcattttaatgtattcctatccctgatgtcacacttaatgctttgggtttttagtatgaattttctttttccctcccaattaagttaaaattaaatgaatcaaatggtcaaaactagtgcatatttttattctatgaaacaattcagatacttattgacattaaaagatcaggggaggagtctttgagcatactctggctagggaagctgctcaataa

SEQ ID NO: 39499 - DNA, 208 bp, Homo sapiens
tgtaaactagattaacaaatcagttaatgagtcagtgtatcaccgggagccctaaaattcccaaactatcaatatcaaactttgccactcgtttataaccatcagtaggatttgaagacacactatgaaatctgcattggagggtatgtgagttatctagccagaatctgtcacaatcgtttgacactagagcaaaattaatgttcct

SEQ ID NO: 39500 - DNA, 363 bp, Homo sapiens
aaaaatgtagaatgtgtctctgattgtttcacagtatgttccttaacaaccagatatgtaagaaaacgtttgggattgagtggtgagaaaagcagactggaaagtacaaataaacccaatccaaatggaaaacaaattaaacagatgaaatgattatgaaagaagatgggggaattaacttgtctggaaaaaatcgagtttagggtctgaactttacagattaaatggcaacacagaacaaatccaaaggaattaaatctattcttttgccctcctaggcatctgggtcagatgcacattttgaggcatttcaacagacagatcagctctgggacacttgcacacttttttggtaaactgcaa

SEQ ID NO: 39501 - DNA, 385 bp, Homo sapiens
tgagacagtcttcgctctgtcgcccagactggagtgaggtggtgcgatctcggctcactgcaagctccacctcccaggttcacgccactctcctgcctcagtctcctgagtagctgggactacaggcgcccgccaccatgctcggctaatttttttgtatttttagtagagatggggtttcaccgtgttagccaagatggtcttgatctcctgacctcatgatccgcccgtcttggctttccaaagtgctgggattacaggcatgagccaccgcacccagcctcaaattagtttttatgaacattatctttacagactttaaaatgctttgaccatgggtatgttataaaactagaagccatttaaagatattttatatagtaaa

SEQ ID NO: 39502 - DNA, 739 bp, Homo sapiens
  misc_feature (33)..(33): n is a, c, g, or t
  misc_feature (35)..(35): n is a, c, g, or t
gcggccgcctactactactactactactaaatncncggccgcgtcgacgtttattgaaatgatgtaattattttctattgctgcataacaaattaccacaaatgtagtggcttgtaatagcatccatttattagctctcagtttagtagattataaatccttatgagacctaaattattgtgttagccagactgagttcttgtctggaggctgtgggtaaaaatctacttccaaactcatttttgttggtagaattcagttcctgtatttgttccccaaggttccagtttccttgctggctgttagctgggggttatcttcattcttctcatttgtctcttccacctttattttttcttttttttttttttgacacgtctcgctctgttgcccaggctggagtgcaatggtgcggtctcggctcactgcaacctctgcctcctgagttcaagcgattctcctgcctcagcttcccgagtagctgggattacaggtgcctgccaccacacctggctaatttttatagttttagtacagacggggtttcaccatgttggccaggctggttcgaactgctgacctcgtgattcacccgcctcggcctccaaaagtgctggaattacaggcgtgagccaccgcacccagcctgggtcttcaatctttaatccagtaaaagtgtgtcaaatcctttccatactttaactttctgacttctaaacccccttctgtctgacctcta

SEQ ID NO: 39503 - DNA, 539 bp, Homo sapiens
tctaatacatcattggttagagttcataaagtgatataaaccctttctagagagaaacctagtcatcttttcaacagccttaaaaatgtccttactgtttgacccagaagtacatttaaaggaattgtctaaggaagtaattagagctgtggagcaagacttttctctataaggtgtttacctaaatgttacaataccaaaaaaacacaacaacccacaaacaaaacaacacagcaacaagaacaaacccataaatgagcaataagaaagcatatccacaacatggactgtcatgtttttctagaacatatcatgatgggggaaaggcatgtaataaaataaggggataggatacaaaattgtattatgctaccagttctgttaaaatgtgtgcacatgcacggacacatgggattggaataaagacaccaaaataatagtagtggtgatttcttgctgatgtgattatgggtggctttttctctctattttctgaattttctataataaaaactaattttataatttaagaagacaca

SEQ ID NO: 39504 - DNA, 334 bp, Homo sapiens
tctaaacttaaaaaaaatgacttcatactctgtattttttgcaacttttttaacctcagattgtttgacttcagagccaaactttctgggtcggcttccaggcacctccgaggaattgctgggtggccttgagctagttatttaatctctgtccttttgtttctttgcctttaaatttgggataatagcccgtactttatgaaggctgttggaagaataaatgagtgaacatctaagtcaggtgcccaaaatattgtgtgtggtgtagtctgcagttttagctacacacacacagacacacacacacacacacacacacacacacacacactgt

SEQ ID NO: 39505 - DNA, 282 bp, Homo sapiens
ccagatatacaatacagatcttttcatttatgcctgaagttcagacatttattcaacagacagttgtcttcctgctgtgcccttgatattgtgctaggcatggaagtacttctttgcctttagtcttcaattaaccttactagagctcttattcaaagactatgccaaaattttaaaaaattatttgtttatggtacttagaggtaatgctttattggagcgatataaaatggattggattcctttaccttcagactttaaagatacaataatgtgaccaaa

SEQ ID NO: 39506 - DNA, 306 bp, Homo sapiens
gcgtcgaccacctgggccctgctgggcgagcactcggctcggccacttagaacctgtgggaccttggtgagttacttcacctcactctgcctcagtttcctcatctgtaaaatggtaacattgtaactgtgtctacgttatgtggttggtggtggctcaagcctggcatataggtgattgtcagtaaatactgtggcataaatgaaggaatgagactctaccttctcaaaatattcttagatgttaacttcaattaatggaaagtttattcccaccccagagccgtgcttggcatgtagtcgacgg

SEQ ID NO: 39507 - DNA, 452 bp, Homo sapiens
gttgtagagacaggggtctcactatgttgcacaggctggccttgaactctggggcttaagcagtcctcctgcctcagcctcccaagtagctggcctataggctagggctaccatgcctggctgttttatttatttagtttttaaatttattcattctcttttattcacaaaggatttaagatgatcacaacaaatacatataagatcagatattatatgtcagtcaagagtaaaaacaaaacataatacaaaggccagagaaaaacaaatacagtgagggtctacacagttactagagttagacctcaaagttagccctgtgttttggggcagccaaagtgaaaaaggaacattaattatatgattcttatttttagaaaagaaaacaacaacagacacccattcttcatttctcaaaggaaatgaagtattttctagcactaaattcttta

SEQ ID NO: 39508 - DNA, 633 bp, Homo sapiens
gagaaatgttatgttctccagaatgaaactgctgttttgtcagcagtgttctgaagcctaacagatagtagtttttaaagaatttccaatttaataaacaaaaaagacattcttggattattttatttggttgatttagtagtgtatttcttttgtatttatttgtcacttttttatataaagaaatctgtaaatctttgtgtctttttgagttatttgaaagggtttttttgcattttaaaagcataattaaaatgcaaattgttttccctagctttttatttatttatgttttaatttttatggtttttgaatgatagaagttttaaatttctttagtcagatccatcagtctttgtaaaataccgttttaaaagcctgggcttttcattggaattagatagactctctgaaaatctttggctgctttgcgaggcatgcacatggttactgctgtgaactattcatgaataggatatccccttctccacctgccactgccaccatcactaatatctatttaacagacctttattgaatgcttactgcatacataaaaggaaactattaaaatggtgtggatacatcagtgaataaaacaaagacgaattcctactctcttggaatttacgt

SEQ ID NO: 39509 - DNA, 2274 bp, Homo sapiens
ctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtgggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggtacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaggt

SEQ ID NO: 39510 - DNA, 486 bp, Homo sapiens
aacaaaaaaaaatttgggttttttttggaacttggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaggt

SEQ ID NO: 39511 - DNA, 1894 bp, Homo sapiens
  misc_feature (90)..(90): n is a, c, g, or t
  misc_feature (93)..(93): n is a, c, g, or t
  misc_feature (329)..(329): n is a, c, g, or t
  misc_feature (388)..(388): n is a, c, g, or t
  misc_feature (392)..(392): n is a, c, g, or t
  misc_feature (417)..(417): n is a, c, g, or t
ccgccgggcgcagagcagagccccagcagaaaggcgggcaaggggccggcggcggcgccaaagaggacaacagcaaagcaagaagggcgnganaggaaaggggagggggacgagcccccaggcgacagagggcccgccgccagccggggcggaacgccgagagcgggccggggcaccgccgcgcggaagaagagcgaccggggaggccgaggcgcaggacgaagagaacggggaagggagaccaacggccgcaaacggggggcggcgggggggcaaggaggcgggcagccggcggccggggaagggcgcggcgccaaagacgccgaaancaaaaagggcgagggcacggacgcgccggagagccgaaaagaggcagccagcagcaagngcgncccgcggcagcagccgggcgccaangagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggtacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaggt

SEQ ID NO: 39512 - DNA, 618 bp, Homo sapiens
  misc_feature (9)..(9): n is a, c, g, or t
  misc_feature (11)..(11): n is a, c, g, or t
  misc_feature (21)..(21): n is a, c, g, or t
  misc_feature (23)..(23): n is a, c, g, or t
cctcggcantntcggacacgngnagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaggt

SEQ ID NO: 39513 - DNA, 1965 bp, Homo sapiens
  misc_feature (90)..(90): n is a, c, g, or t
  misc_feature (93)..(93): n is a, c, g, or t
  misc_feature (329)..(329): n is a, c, g, or t
  misc_feature (388)..(388): n is a, c, g, or t
  misc_feature (392)..(392): n is a, c, g, or t
  misc_feature (417)..(417): n is a, c, g, or t
ccgccgggcgcagagcagagccccagcagaaaggcgggcaaggggccggcggcggcgccaaagaggacaacagcaaagcaagaagggcgnganaggaaaggggagggggacgagcccccaggcgacagagggcccgccgccagccggggcggaacgccgagagcgggccggggcaccgccgcgcggaagaagagcgaccggggaggccgaggcgcaggacgaagagaacggggaagggagaccaacggccgcaaacggggggcggcgggggggcaaggaggcgggcagccggcggccggggaagggcgcggcgccaaagacgccgaaancaaaaagggcgagggcacggacgcgccggagagccgaaaagaggcagccagcagcaagngcgncccgcggcagcagccgggcgccaangagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggtacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatatttgtttcatatttgtttcatatttgctgaaaagtaaaacaaatatgaaacaaatataaaacacatttgtttcatgggagtaaaatatactgcatacaaaaaggt

SEQ ID NO: 39514 - DNA, 1368 bp, Homo sapiens
attgagtgacacacagcgtgatgctgggcaggccccaagctgaaaagcatctcctccaacttactttattcttagcaattcattcctttggtttgaaaattcttcagcatcttcaagagtcctttactaatgcatcctttgggggagttgtgctaaattatcaactcacaaggatgagatggctggctctagggagccagcctgccaacatggatgggctgtcccaggctctcaagtgagctcaggtctgtacactgcactccagggaagagtaaatgtgcctggggcatagaatggagactttggagtttggagtttggagtgggtttggggacatcagcttctctcttccagttagtctgataagtcctttgttgcctggccctggaaaccacttgtgctccgaaaatgccattctctggaatgtagctgtggagtagggagagagttggcccctgtgttctgtaacccaagcaagtactgtctcactgccatcttggggcagactccgcagtaaggagaatctctcttgcctttttgtgtttcttggtttcttcctttgtaaatacaaggcatagtctctgcccttcccccagattgccagaagagtgggatatattgttctagcaatataaagctctgaggcctttctgcaggactgtagacaccactttgctgtgatagtgaagaatgtggggagtgttgtgaggctaggcgagcggcccggccttgcccatgacagctcagtctcctcccctcataacttttttacctaacagagaattaaaaaaaaaaaacaatttagctgggcacagtggctcatgcctgtaatcccagcactttgggaggctgaggcaggtggatcacttgaggtcaggagttcgagaccagcctaaccaatgtagtgaaacgctgtctctactaaaaatacaaaaattaggcaggcatagtggcgcatgcctgtaatccgagctactcagatgctgaagtgggggaatcacttgaacctgaaaggcagaggttacagtgagccgagatcatgccactgcactccagcctgggtgacagggtgaaactccggctcaaaaaaaaaccaaataattaatcaacaaggaataactccattggtctctaataatgagacagagggggaagaaacttcgtccaactattcaggaagattaagcaattctgaaccgttaggagtagaagaagtgagcgtattctcgtccaaaacacttggaaaatgtctgttattctctgaagtgaatggatctaaattcagaaatgctgagagaaaaaatgaaagtgataaatatggctccttcgctgcattggttcttctatgaatgaagttttttttcattc

SEQ ID NO: 39515 - DNA, 440 bp, Homo sapiens
actcccgacctcaggtaatccacccgcttcagcctcccaaagtgctgagataacaggcgtgagccaccgcgcccggccaacaccattaatttttaagtacactaatatattggaaattttctaaaacaaagcttgaaacaactatcaccaaaagttctgtaacacaaagagtcaataccactgaacacagtgttttcacctgtaacggagtaaacattctcatttcagaatattattgaaatagttaaggtattatcatgaggtacagtacctgacacagaatgggtacttatttaaaaaaaaatttttttttaaaaggatgactgtaaggggtcattccccatggattatggataattagggccttaccttctcaataatgcaaaactacattttcaatattgtagcatcactgaatgttttgtccaaaactagattta

SEQ ID NO: 39516 - DNA, 400 bp, Homo sapiens
acagattttcattgcaaggactggagtaagttttgtggggcagatgaatgcctgagtttgcccttgagccaagtttcagcacctgaagaccacaagacttggaaaggacattcgaagcaaaggggacccccagccttgaaaacatggaggaggggaagctgctgtagaggtgttggggaagtcagttgtgtaggtgatttatgtccatatcattgagaagttgaacctcagattacttcttgatgaataacttagcagtggttctcaaactttagcatctgggctgggtgcagttgttcatgcctatgaccccagcactttgggaggccgaggcagtaggattacttgagcctaggagtttaaaaccagcctgggcagcacagtgagacccagtctctac

SEQ ID NO: 39517 - DNA, 4028 bp, Homo sapiens
  misc_feature (434)..(434): n is a, c, g, or t
  misc_feature (1650)..(1650): n is a, c, g, or t
  misc_feature (1744)..(1744): n is a, c, g, or t
  misc_feature (2095)..(2095): n is a, c, g, or t
cttcaaagggttgagtctgggggctcatcagaagaggtaatcccaagtgacttggaatctgcaacaggtgggttaggacctcatccttagatattgctttaaccaatttatgggtaagccatagttctgagcagagtcacgtgctcacgcgccccacgtgtagtgacaacgggaatgtaggcttaaacataggtaacagcttcaaaagagtttgtaaaaacaaggctgtgaatatcaatataattgtgagacttttggggatttattgtaggtttgaacgtaacttgaaatacagtgatttgtagacagtcagtaattgcttcacttgctccatttggaattttgtaactattcacttctccagcagcataaggtggttaagaagacagtttctgttcgttgtaaaaaattactccaggcttaaggaggacaantattgtgtctttatattcatatacccaggatttagcacagtgcctaatccataagggccacactaaaatgtttgcccagtgaataaatcctggataatatcatcctgtctgcaaagccagtattacagagtgattggttgccagtaggggagatagctccctttggttacacaaattgtggcagacattgaaccactccaaaagaaactaaagctatttatttggggattgaaacaaaaaagcctacacaacttgaaaaaagcataaagacactcagatggaaccatagtgtctcccagcagatatcaccagatgggggtgggggtaaataattgcagtcacatatgcagcaggtatatatatttttactaatggcttattcttaaacaggacttgaggccagagaaatttcaaggataaattgctttgggagaatgcctgatatcaatgtctcctgagacatagaagttttccaaaataacaaatcaccagatatattattttgttgcctcctcttccttcccctggcccctgccaatatgcttatttacaagagttaccttatcagttgtcttaggagaacacatttccttcaacagaagtcacagtatcatcttatggtcataattttacaatatccctgcctctactgagaagagatacatagcgaatggagatgtgctgagccaatgaggaattaatcctaggcagcactagtagatgtggccacagctctggccccaccccactctggtggtcaggccaaaaaagaagtcaggtaagaagtgtgaaaggaaattcaatcttgggacccccaaactcattaagccacagggaaaattcaagctgggaactgggtcacgcaaacatgcctcccccttttggttcctaaataagatggctacaagatgaaaagctacatgcctcccccatattttgcccacaagggaattcccagtgagctgctagatctttacactaaaggtgtttctattaaaatttcaccatggcaatataaattgatagtttatagatgcagtcacccctggcccaccagacacaaatgcatatctgattgttcccctggcccagttttgtctgttatcttatataaaatgcagattccctgcaattttcctctgcctcatttgtctgtgtcatcttatgttaaaaaaaaatgcagattcactgagccagacaaaggcatgaatgactntttttccctacccacctcttacatgaaaattgtgtacttctcaatatcctgccctttcccctttaaatttggagccttcaaaatcatctttggngaaaggcatagacctgtctcctaggtgtgcatccttaactttggcaaataaacctcctaaaataattgagacttgtcatttttctcgattgacagaagaaaagacagagccaagaggatggcagtgtacttggctacccccagagcctagctgaggctccagccctgggcacttcactggagcattcccttgccagcagaggaacctgcagcctaacctcatgctggggtaaccttaatgtgggcaatccgtcttactgtaatagacaaattgcctgctttcacttaatccacagatttacaagggacaaactttggccctaggaatatttattgaatatcatttcatccntgtgacttccacttctttctgattcccatatcaccagcccaagagaacttgagtatctgttcacagctttgctcctctttccccacattaaccacaaagcaacggaaatagaataaagagacaaatgggtaactctaagtaggttcatcacattcattacatgccctgtatccagagccaatataaatggtcttgattctgattgtgttgaggtataaaaacatgctgatttctgtggcaggtattaatgattattacttgtgtattcatttgctcactgctccattctggatgttcttggtctcagggcctaaggatcattttctcggatgcatcacggctcatcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggactttagtggccaataaaaaagaaattcctaatttcaacc

SEQ ID NO: 39518 - DNA, 324 bp, Homo sapiens
tcggcacgcgtcgactttttttttcagaggtaacagagattttattttgaagaagtcagagtaactatgtggatggggctgactggtttctgtagggaagtaaactcatgaaaattattgcattgttaatctcaggggtgactcgataaatgtgtgtaaacttaatatggtgtagagagaagacatgagagcagccaagatattcagaactggaaactttcaaaaaccacttcccaaactcgatatcattttcaacataggaaaagttttatggttgacttcattatagcattccaaaaataggctgtgaattgccaaaacttg

SEQ ID NO: 39519 - DNA, 3615 bp, Homo sapiens
gggaaggcagaagcaatctctgccgagagagtcagccgagcggccgcgcggagaggaggggcgggcggtccccaggcgggcgggtgcagggcgcagggcgccgacctgctggagagggggcccgggcacgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggcaggcggcggcgggggtctgcgggacccaccggctcttcgagggccagcgcaatacctgcccaactttatccagagcgtgctgtcgtccatcgacctgcgcgaacgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacagagtggccaaatcaatgaaggtccctgtatatgagaccccagctggatggagattcttctcaaatctgatggactcaggacgttgcaatctgtgtggggaagagagctttggcactggctctgaccacctccgagagaaggatggcctgtgggctgtcttggtctggctctccattattgctgcccggaagcagagtgtggaggaaattgtccgagatcactgggccaaatttggccgccactactattgcaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacagggcctaaggatcattttctcggatgcatcacggctcatcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggactttagtggccaataaaaaagaaattcctaatttcaaccttatccaaggattgtgggtttttacttatttgtttgtctcaccagttgagaaactccagtactggtcacctatcctgataaatctgcctttcagaaaacctgcaagggctgtttttcactattatggcaagagacatgtattaaatggaacagaaaaggtaagttactcaaaactgcctttgggagtcagcagaaactgaaatggcatctagacctccactgtaactgtcttcatttcaaaataataggaaggtggctttgagctgagattctaaaacaaaacc

SEQ ID NO: 39520 - DNA, 3557 bp, Homo sapiens
gggaaggcagaagcaatctctgccgagagagtcagccgagcggccgcgcggagaggaggggcgggcggtccccaggcgggcgggtgcagggcgcagggcgccgacctgctggagagggggcccgggcacgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggcaggcggcggcgggggtctgcgggacccaccggctcttcgagggccagcgcaatacctgcccaactttatccagagcgtgctgtcgtccatcgacctgcgcgaacgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacagagtggccaaatcaatgaaggtccctgtatatgagaccccagctggatggagattcttctcaaatctgatggactcaggacgttgcaatctgtgtggggaagagagctttggcactggctctgaccacctccgagagaaggatggcctgtgggctgtcttggtctggctctccattattgctgcccggaagcagagtgtggaggaaattgtccgagatcactgggccaaatttggccgccactactattgcaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacagggcctaaggatcattttctcggatgcatcacggctcatcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaattgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggactttagtggccaataaaaaagaaattcctaatttcaaccttatccaaggattgtgggtttttacttatttgtttgtctcaccagttgagaaactccagtactggtcacctatcctgataaatctgcctttcagaaaacctgcaagggctgtttttcactattatggcaagagacatgtattaaatggaacagaaaaggtaagttactcaaaactgcctttgggagtcagcagaaactgaaatggcatctagacctccactgtaactgtcttcatttcaaaataataggaaggtggctttgagctgagattctaaaacaaaacc

SEQ ID NO: 39521 - DNA, 2605 bp, Homo sapiens
gggaaggcagaagcaatctctgccgagagagtcagccgagcggccgcgcggagaggaggggcgggcggtccccaggcgggcgggtgcagggcgcagggcgccgacctgctggagagggggcccgggcacgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggcaggcggcggcgggggtctgcgggacccaccggctcttcgagggccagcgcaatacctgcccaactttatccagagcgtgctgtcgtccatcgacctgcgcgaacgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacagagtggccaaatcaatgaaggtccctgtatatgagaccccagctggatggagattcttctcaaatctgatggactcaggacgttgcaatctgtgtggggaagagagctttggcactggctctgaccacctccgagagaaggatggcctgtgggctgtcttggtctggctctccattattgctgcccggaagcagagtgtggaggaaattgtccgagatcactgggccaaatttggccgccactactattgcaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacagggcctaaggatcattttctcggatgcatcacggctcatcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaattgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaattttaataagggtttcctcctattttcaaaaatttttttacctttaactgaaccttttaaatccaccttcaatttaaattggattttggactttctgctt

SEQ ID NO: 39522 - DNA, 150 bp, Homo sapiens
aatggtgtttcctgtactattcagaacaaaatactctggggagaaggttctgcaaatatttaatattgctgtgtatctatttttagttatgggaccttatgtgagaaaagttctgtgtgatgagctgggggccccagccaattctgcaat

SEQ ID NO: 39523 - DNA, 114 bp, Homo sapiens
agggaggtggggggttatgtcaaccagactgccccctctcccagagctcagacccagggctctgagagtcctcaggtcttcgtgtctcaagaggaaaaaaggagttggggtggg

SEQ ID NO: 39524 - DNA, 1107 bp, Homo sapiens
taattatgcctttatggcagctaaattaagcattttcaacgtgttcaccattagtcaccttttgaacatactttgtcttcattcttaaatattatgtttcactctttactatagaatatgttgttaagattgttttgtctaaaatcaagtatcgacaagtttaaaaaaaagattgttttgtgtttggttttctgtatttccactatgctctatggaactatgggtttgtttttgttcaatttgtttggtatttattagacttcttgaatctgtggattagtgtctttcattaattctgtaaaattctcagccattttatatgcatatattgcttcttcccattgtttctctttttttttttatcgatttaactaaaccttttcactcttttctctatgtcttttactctgttctttcgtagtacattctggataatttattctcaagttatttccattgttattaaactcggcctctgaaatcttaaatcatatattgcaatttttagtttctgaagttctgtttggtttgtgacacttttacagttttttatttcttactattttgaggcttaattttatttctttaaacatggaaagtatagttgtttttataatctctatgtttaattccactgtctgaattccctttgggggagtctgtttctgttgtccattattcctgctgttttacttcccagttcacctttactttgaagctgtagttcttttgggcacaagattaagatggagagggaggtagttgtcagactccactccctggatgggctcctggcttgaacttgtttctgttatctcataaaggcactgaaactttagcttttaggtcagagaagtcctcaggatgaaatccattttgaatattgggcttaatttctggttttcaccttctagattgtgtccaaattctttactatcttgttagcttttctatttaagaattaatatttttggctgggcgtggtggcttacacttgtaatcccagcactttggtaggggctggtctcgaacttctgacctcaggtgatccacctgcctcagtctcccagagtgctagggttacaggcatgagccactgcgccaaaa

SEQ ID NO: 39525 - DNA, 1130 bp, Homo sapiens
taattatgcctttatggcagctaaattaagcattttcaacgtgttcaccattagtcaccttttgaacatactttgtcttcattcttaaatattatgtttcactctttactatagaatatgttgttaagattgttttgtctaaaatcaagtatcgacaagtttaaaaaaaagattgttttgtgtttggttttctgtatttccactatgctctatggaactatgggtttgtttttgttcaatttgtttggtatttattagacttcttgaatctgtggattagtgtctttcattaattctgtaaaattctcagccattttatatgcatatattgcttcttcccattgtttctctttttttttttatcgatttaactaaaccttttcactcttttctctatgtcttttactctgttctttcgtagtacattctggataatttattctcaagttatttccattgttattaaactcggcctctgaaatcttaaatcatatattgcaatttttagtttctgaagttctgtttggtttgtgacacttttacagttttttatttcttactattttgaggcttaattttatttctttaaacatggaaagtatagttgtttttataatctctatgtttaattccactgtctgaattccctttgggggagtctgtttctgttgtccattattcctgctgttttacttcccagttcacctttactttgaagctgtagttcttttgggcacaagattaagatggagagggaggtagttgtcagactccactccctggatgggctcctggcttgaacttgtttctgttatctcataaaggcactgaaactttagcttttaggtcagagaagtcctcaggatgaaatccattttgaatattgggcttaatttctggttttcaccttctagattgtgtccaaattctttactatcttgttagcttttctatttaagaattaatatttttggctgggcgtggtggcttacacttgtaatcccagcactttggtaggtcgaggtgggcagatcacttgagggctggtctcgaacttctgacctcaggtgatccacctgcctcagtctcccagagtgctagggttacaggcatgagccactgcgccaaaa

SEQ ID NO: 39526 - DNA, 1096 bp, Homo sapiens
taattatgcctttatggcagctaaattaagcattttcaacgtgttcaccattagtcaccttttgaacatactttgtcttcattcttaaatattatgtttcactctttactatagaatatgttgttaagattgttttgtctaaaatcaagtatcgacaagtttaaaaaaaagattgttttgtgtttggttttctgtatttccactatgctctatggaactatgggtttgtttttgttcaatttgtttggtatttattagacttcttgaatctgtggattagtgtctttcattaattctgtaaaattctcagccattttatatgcatatattgcttcttcccattgtttctctttttttttttatcgatttaactaaaccttttcactcttttctctatgtcttttactctgttctttcgtagtacattctggataatttattctcaagttatttccattgttattaaactcggcctctgaaatcttaaatcatatattgcaatttttagtttctgaagttctgtttggtttgtgacacttttacagttttttatttcttactattttgaggcttaattttatttctttaaacatggaaagtatagttgtttttataatctctatgtttaattccactgtctgaattccctttgggggagtctgtttctgttgtccattattcctgctgttttacttcccagttcacctttactttgaagctgtagttcttttgggcacaagattaagatggagagggaggtagttgtcagactccactccctggatgggctcctggcttgaacttgtttctgttatctcataaaggcactgaaactttagcttttaggtcagagaagtcctcaggatgaaatccattttgaatattgggcttaatttctggttttcaccttctagattgtgtccaaattctttactatcttgttagcttttctatttaagaattaatatttttggctgggcgtggtggcttacacttgtaatcccagcactttggtagggtgggcagattgtattgcttgagtccaggagtttgagaccagcctgggcaacatggtgaaaccctgtttcacgaaaaa

SEQ ID NO: 39527 - DNA, 400 bp, Homo sapiens
atttatttatgcaagagtcttgctctgttgcccatgctggagtgcaatggcacgatcttggctcactgcaacctttgcctaccgggttcaagcgattctcctgcctcagcctcctgagtagccggggttacaggctcacactaccacacccagctaatatttgtatttttagcagagaaggggttttatcatgttggccaggcttgtcttgaacccctgacctcatgtgatccacccactttggcctgccaaagtggtgggattacaggggtgagccaccaagccagccttaccacactatttaaaattacctccctctctcactgcccccctttcctgctttatttttctcagtagcatttatcaccatgtaataggctatctacttatttattgtctg

SEQ ID NO: 39528 - DNA, 189 bp, Homo sapiens
caggttgtctgggccaaggggatgcaattgtctcttctctgcacccccgtccagggcacccggcttctgcccgtgggttctgcctggtccctatgccacccacatctggggctgggcttcttccccgccacggtgggggtacgtactcacctgcattttctccagcatctcaaagaactccgacgactg

SEQ ID NO: 39529 - DNA, 832 bp, Homo sapiens
gatatttgtcctcatccttatgcttatctaatggcaattagatgtacttctttagagaagagcgtgatagaggagacagtcaacagtcactggcaaacctcaccttcaagcctaaaacagctcgaaggctgagggactggactgctggtcccagatgaaaccctcgaccctcagggagaactgcccgtttgcccaccctttcccaactgactctttctgaataatgcccacatgcacactgggggaacggggtggagccatgggaagttctcaccctgtgcagtggggaggagcctggtctcttcagccaatgtctgtggtggcctgctattcaatctgcgaggtgggtcggggggttccctctgttagcaggaccccctctcactttgctgagttttttttttttccttctcacccaataaattcagccctcctcacccttcaatgtgtctgtgtgcctaatttctcctggtcatgacacaagaacctggatttagctaactaaggagcaaaaattctgcatccgcaacacaggtttagggtcttctattttaaaggatcagggaagccctctaacaagatgacatttaggcagactggaatagaggaagccaaccatatagatatctgggaggagagagttctagcagagaacaggtagtacagactacaaggtgagactatacttggactttctctggataggaacaaaacagaaagagtacaagcaaatgtgggtgatgaatcataggcaacaaagagaccaaaggtgcagaaggccagatgacattgggtcttgtaggtcacagaaaataagtacttgggatttcat

SEQ ID NO: 39530 - DNA, 413 bp, Homo sapiens
ttcgcagaaattcagctttcttgtgtgttagattaggtcaaggcttttcaaatactccctcccataaagcattttcttcaaagaaagcctaacattaaagcagatcaaagtagaattgctctgcttgaagtggggaggggtattgccccctggctcccaccctttcctatccccaagaaacccctgaggcacttccacaaagtccccagggctagcgcagtttgacacgatcaggttcaccttgtaagggtttgatgtgaaccttctttgagttggcaccaagcaaaacagccaataaagagtcattgaaagtgattgcattaaaacatggtttctatgaggactaaaaagtaccttccaggtttcctagcaacagaaatcaaggtctgctggccacagcagaaaaaaaaaaa

SEQ ID NO: 39531 - DNA, 339 bp, Homo sapiens
aacaagggttgccttaaccaaagattgtctgaaaggcacacaggagcaaatgcagcaggaagaaactccccatttgtgaggcagcctgcggggttggggttaacgggcagcagcattatgtaagatgtgcccggatcccttaggcagagttaatgcttattaactagaaaagaaaacagcctttatcggctggcagataggatgttaattggcttccgtttactgagagattacaggatccatttcacggctgcttataataaactccatccacagagaaactgtccccacccccacccaacatttgtacaaacatttcctgagtcccaaggggtggag

SEQ ID NO: 39532 - DNA, 1830 bp, Homo sapiens
tagagacggggtttcaccatgttggccaggatggtctccatctcttggcctcatgatccgcccacctcggcctctcaaaagtgctgggattacaggtgtgacccaccgcgctcagcccacatgggctcttttatcacaatttgtgtgtgtgtgtgtgtgtgtgtgtatgtgcatattatgggtgtgtgtaggaaaaagaatgttagaaatgtaccaattttgaaggcgtagactatgaaattacaaatgcttcaaaattttcttcccaatacttacgtggcattttataaatttccaccaataaacgtgtattatttttattgaaaaagcatatttttaacatgcccttctagatgccctcctagccagactgaatcacctcccatttgattttttttaattttctacctttaggttccggctcattcattaacatcaatttccattcataagtcctcacaaacccacttttcctcttgcctgagtgcctcacataccctactgcctgagatggttccagaggcggtctcctctctcccttagaaacaccaggcacacacctgcccccagtctcgcctgcactctcctttcctcccgcagagaggcattcctttctcctcctctcatcctacacacactataagagacaactgaaatcttgcctcctccagccagcttcttaattcatttgttctcaaagccctggtttgagctcacacagcatctagagtgttttacaaaatataaaatattattatccctgccctgaattttttgttttggtatgtgtgttattttcccctccaataagattgtgccttggagagggctgagaacatagtatcatagataaatgaataaaataacataaaataaaataaaaatacatataccctttgaactaactattccacttctatgtaagcacaattatatgccagtaacactcattttaacgctactttagtggcaaaaaattgtaaacacctcagatgcctattaaaagaggaatggtttaaagatactattatagccacactatgaaatataatacagtagttaagaagaacgagcttgatttgtatgtactgacaagaagaatctataaggtatgtaaacagttgaaaaaaaagctacagagttttacatttgtcaagatctaacactaaacaaaattagaaacatgtgaaatccatatacacacgtagaaaaatacatataatgagccgtggatggaaactcgcaaatgtgatattaaagactagcactataagactgagtgagatttggagagtataggaaaggaggcttttagttaatatagagagatattcaaaaatttatgagtgtgatctcatgtattagttattcggttaaagaaacaaaattaaatgaaaaatacatttttaaaaaggttgcaattctgaattatgggagagaaataaaaattagcaaaacatatttgcaaagtggctcaggaggaaggagctgaaaccctaagaatgggtgagtttttttttttttcagagacaatacagaaaagaagaggcaaaggggccgagatgggatacagacctgtatcacacaggtgtgtgcacattctcatttagaactggaacaagggagtcagatttaaaattctggtgcagattccaaaggtgttctctgaggaaaagttcttttgtttggagatgccatgtgttacagcacagaaattgatcaacctggcttagagcgtcacattcttcctctgttggagcaagaggtacagaaggaattggaatttagtggaattgaagatctttttgaacagcatctgcagaatgtagt

SEQ ID NO: 39533 - DNA, 330 bp, Homo sapiens
ggcttttggatgggaggctaatgatatctcactgtggttttaatttgctctatcttgatgactaataaagttcagcacattttctcatgcttactgaccatttggatatcctcttttgtaaagtttctattcaaactttttgtatatattttttctatttaattacctatttggactgacttctaacattttttatatattttagataagagccctttttcagatagatatattgcaattatgttatctatgtggcttacctttttcctctcttaatggtatctattgaaaattgaactatattaataaaattcagtgtatcagatttta

SEQ ID NO: 39534 - DNA, 604 bp, Homo sapiens
agggcctactatatgagaggagaagtgctaggtgctgggacatacagtgaacaagatagaaatccatacacatataaaatgtaatttcccatgaatatgtgtcagatcacttctggaaaagaaagatacctttctattgttggagccatacacttcataccaactaatgttatcctagtatttatctatacagtatttagtagttttaagctaatttattttcaaatttgtgaatgccagcttatattattattgagattctcaagtgggaatgacgcatgtcctctaatcctgctagtgcactttggagttatgccagaaattttgatgtgattcttctgtccacctgctatctagccatctcccttcactccacacatttgtgtgcgtgtgtttgagatagggcctcactctgtcacctaggctggagtgcagtggcgtgatcacagctcactgcagcttcaacctcccaggctcaagctactcaggagactgaggcgggaagatggcctaaaccttggaggcagaggttgcagtgagctgagaatgtgccactgcactctagcttgggtgacagagcaggattctttctcaaaaaacaaaa

SEQ ID NO: 39535 - DNA, 463 bp, Homo sapiens
agggcctactatatgagaggagaagtgctaggtgctgggacatacagtgaacaagatagaaatccatacacatataaaatgtaatttcccatgaatatgtgtcagatcacttctggaaaagaaagatacctttctattgttggagccatacacttcataccaactaatgttatcctagtatttatctatacagtatttagtagttttaagctaatttattttcaaatttgtgaatgccagcttatattattattgagattctcaagtgggaatgacgcatgtcctctaatcctgctagtgcactttggagttatgccagaaattttgatgtgattcttctgtccacctgctatctagccatctcccttcactccacacatttgtgtgcgtgtgtttgagatagggcctcactcttgcactctagcttgggtgacagagcaggattctttctcaaaaaacaaaa

SEQ ID NO: 39536 - DNA, 216 bp, Homo sapiens
atcacctaacaacacatttatcagaatgtatccccatcattaagcaatgtatgactgtatataaaaaagagtatacatggaaaaatatattcctgttttttgttacaagagctcatatagtcgaactaagtgtgcaagtgatgttaactatcctatttcctcactacacaatcttaaatccttgtatccaacttttacccctcactgtacttaaaa

SEQ ID NO: 39537 - DNA, 373 bp, Homo sapiens
ggaaactgccagattgttttccaaagtgactatacttttttccttcttttaaaattgtataaaatatatgtaacataaaatttgccaccttggcccaggcgagtggcccacacctgtaatcccagcactttgggaggctgaggcaggcggatcaactgaggttgggagatcgagaccagcctggccaatgtggtgaaaccccatctctactaaaaatacaaaattagctgggtacggtggcatgcgcctgtaatcccagctacttgggaggctaaggcaggagaatcacttgaacccgagaggcagaggttgcagtgagcccagattgcaccattgcactccagcctgggcaaaaatagcaaaacccagtctc

SEQ ID NO: 39538 - DNA, 307 bp, Homo sapiens
caaaatgttatcctagtatattttatccaggaaaaaaaaatgtaaggtcataaatctgttcaatttagacaatagatatttttgcaagagtttcacggatatttaaaaaggtgtaggctagacttgtgtgaatgtaagagatttttatgatcataagagcaatgcatgtttactatagaaaatttggaaattgtgaagatgaaagctaaaatcaccagtaatctctacatttgtctcttttttcctgtgtgtgaaatggagaaagggatgtgtgagtgctgttcaatcttctgccgtaacaacttgg

SEQ ID NO: 39539 - DNA, 428 bp, Homo sapiens
tcctcccttgtcagtggaaacaaatagaatgaatagactgtgattcacatcgattttccttaaacaaatctcactaaaatctatgtgtagcctttcctaggaggacagatgtcaccttgcaacttgtagaaatatgtcgtgaaccggctgggcacagtggctcacacctgtaatcccaacactttgggaggccgaggcgggtggatcacgaggtcaggagatcgagaccatcctggctagcacggtgaagccccgtctttactaaaaatacaaaaaattagccgggcatggtggcgggcgcctataggtccagctacttgggaggctgaggcaggagaatggcgtgaactcaggaggcagagcttgcagtgagccaagattgcgccactgcactccagcctgggtgaaagagcaagactccgtctcaa

SEQ ID NO: 39540 - DNA, 380 bp, Homo sapiens
cgtgggggtcccaagtgggactggaaccaccgcgaaagaggcggggctgcgcggatcttccacaccagctcctcccttccgtcagggggtgctgcgcatgaacgttttcccatctctacctcttggttatccctcagcagagattcttcttttactctgtacagttttcagcatccctcaagctgatatttcaattaaacaaattttagaattctgagaaatggcgaaataatgtaaaagaaacaaatgatattggccctaaattatcctccagcccctgctgctcatcggacactttatgaggttacaaaggaccatggcgctgcgcatatgggggatccattttacccaccgtacttagatcaggctgtgacttccgc

SEQ ID NO: 39541 - DNA, 661 bp, Homo sapiens
taacctttacatagttcactatggcatgcatattcccattgcaatgatacatacccagatgaatattatttttttagagtgcctctctatttgatatttaggtcaactagtgttaattttctggtataacaggaaaactgttcttattcttaaaagatacatgctgaaaatattttgggataaagtgtcatgattgctgtaactttcaaaagggtcaacaacaacgaaacgatgatattggtaaagtattatatatagagaaaatattaacatttttaaaaatttaaatgaaagatgtacaggagtgtgctgtactggtcttccgtttctctgaatgtatgaaacatttccataatagaaagttgtggggagccaggcatgctggttcacacctgtaatcccggcactttgggaggccaaggcaagcggatcacctgaggtcaggagtttgagaccagcctgaccaacatagtgaaacccctgtctctactaaaaatacaaaaattagccgggcgtggtggcaggtacctgtactcccacctactcaggaggctgaggcaagagaattgcttgaacctgggaaatggaagttgcagtgagccgagattgtggcattgtactccagctctgtctccttttgagacagcaagactccgtctca

SEQ ID NO: 39542 - DNA, 342 bp, Homo sapiens
tggagatggggtttcaccatgttacccaggctgatctcaaaaccctgggctcaagagatggctgcctgcctcggcctcccaaagtactgggttacaggcacaacccactgtgcctggcctgatttgggactttttgagttgatatttggattagaattgggtcttagagttgatgctggaatgggttgacttttagggatgtcgggatggagtagatgtatgttgtacatgggatggacatgaatcttggggagccagaggggttgaattgtgttcccccaaagctcatgctgacccaaaacttcagagtgaaaccttatttggaaagagagtctctgtaga

SEQ ID NO: 39543 - DNA, 518 bp, Homo sapiens
ccctcacctcacggctccctcacttgtgaattaaagtcagacactgccgtaaggttcttctggttcctgctttgtggagaaagctttcagcagcaatatctgggatcactggtgtattaaatgtcaggcctcgcatcattattctgccctgagctgatggtaaaccgggcacccagccttttagctttcatccagcacgagggaacttgccttcagatgtgacacgtacaagtcaaaaaagctcagagtcagctccaacgtctattggatcccactctatcgcctttaaaaaggaaaagaaaatcgaattcacagaaccgaggctaaatacgaccgttaagaacggactgcattcaccatatttccatgagagtggcaaagagaacaaagataaatgccaggctacatcttggatcctttgccagcttgtggaagaacttagcagaaaaagatgtgaactctactgtttaggaataaaataacttttaaaaataaattattgaaaagtgaaaaaaaaa

SEQ ID NO: 39544 - DNA, 601 bp, Homo sapiens
agagtagatggacatgtatctgtttccaataccactgagtgaggaaaataagccacagtaccatgaaactgtagaacaccaaggacaaagagaagctgcaaaaactgaaaaatcaactcttcaatcagaaaattgaggcttcagggcaaaccattctcccaaaaactggagggaatggtgcatactgagaatcacagattacctccagaaacctcaccagattctcagggtaaagagaaaaatctcctcaagctttaggtagggagaaggggaaatcatcatcttgaaataagccgtagcactccttagcaatggtttgctctcaaagtaaactgtttaatcaagcctaattgacatgtgctttaccagagcctaacagacctggaggaagatgtgttagtccatcttgcattgctaaaaaagaatacctgagactggtaatttataaagaagaggggtttatttggctcacatttctgcagactgtacaagaagcatggcaccagcatctatctgcttagcttctggtgaggcctcaggaagctttcccttatggtggaacacaaaggggaacaggcacagcacatggagagagagagag

SEQ ID NO: 39545 - DNA, 647 bp, Homo sapiens
atattcttgaaaaggcttcgtaggtattgacttcacatacgaatttggaattattcctccttaatatggggtttaccatttgtaataaaagtgagtaatgcaaaatcagacacttattgaatctatgtaagtaatgaatgtttctgtgaataataaggagagtatgtaaaggtgtctgcattttcaggggtcaatgagaatcaaagttcctttaaaagttttcatttttgtttacaaaaaatctattttgggttagatatatcttaaagagaagaaatttttttctcatataacccataaaaataaaacattataaatattacccaaaatatttcaaatattacatttaaatttcctctctttaatgtattcatttctataaaattaatttttattccactgcatcttgagtcagtagattgcttcatgactggaaaagaattcttgtgactctcagtccactgttatctaaaagtagtctgagtaatgtcatcttctaagtctgatttcagaactttgtcctttgaagtaaaatattagaatgataagtaaaattatctattaagattttataaatcaagctgggctcagtggctcatgcctataatcccagtaaatcaggaggctgaggtgaaaggatcacttga

SEQ ID NO: 39546 - DNA, 434 bp, Homo sapiens
ctttctgccccaatacacttgtcactggaagaaatcacacagggggtagggataaagcatgaggtatcatgattccttcatgtaaaaattttgctcaaattaaaatgtgaacatagtataatatgtaaaaaaaactggacctccttaaatcctttataaagcaaggcaatgtgtaaacatatgaataaataccaaggttttattttaagtaatagctgtgaatgttaaaagtaatattattttccttagaatagtttaatcacatatcccttttaaattttttaagcctttaaacgtattattttcagtctgggcttgggggctcacacctgtaatcctagcagtttgggaggctgaggctaggggatcacttgagcccaggagtttgagaccagcctgggcaacataagaagacctcatttctgaaaaaaaaa

SEQ ID NO: 39547 - DNA, 550 bp, Homo sapiens
  misc_feature (59)..(59): n is a, c, g, or t
  misc_feature (87)..(87): n is a, c, g, or t
atcctctaaatgtctgtcaatgaaggaatagataaattgtaatatgttcatataaaatnctgcataaataagtgaaatttataaatntactaacgaatgaatcttgaaaacagagttgggagataaaagcaagctgttgaagaacatggtcagtatcctctcacttatgtaagttaaaaactccaaagaacattatctatattggtaatggcatagacatgtgtggtaaaatataaaaatattaactaaaagttctatacgcttcaggatattgttagtataataaggcaggaagtggatagcattggggtgagacagtggtttggtggttatgtttggttactttagttatgttagtaacattttttttttaaagaaggatctggaataattatggtaaaataatagtatttgctaagactagatgattggtgtactggatttcatccgctattttctaagtttgttatgaacgcttaaaatatatatgtatgtagtaaaattaatgtaaatttgtacaaataaaaataaatggcatgtgatatatggc

SEQ ID NO: 39548 - DNA, 770 bp, Homo sapiens
agttaacctggactataatacacatctctttttctttgttaagatattagtgaagcttttgattctacgtaatgttctcttgtacaggttaaaagtattttatttttagagattagtaacaaattggcttgaaggtagaatgcaaaagtcaacctaaaattattggaacagtatcttttaaagcttgataccaaagttcattctcattagtgtttgtattgactgacttcagtgatgattatactaaattagtgtaggtgctagacatctcatatttacaacctcatacacatttctgccatatcttgtttgatttgttataatgctacaatgtaactagaacatgtagtatttaatttttttttttcaatgaagattccaacttagatgcaaaagaggcatgagtagcccttgggcaaacaacataacaggattgatttaaaacccacataataatgagttctattaagcttatgatcctggccaggtgtggtggctcacgcctgtaatcccagcactttgggaggcggaggtgagtggattacctgaggtcaggagttcgaaaccagcctggccaacatggcaaaaccctgtctctattaaaaaagtacagaaaattagctgggtgtggtggtgcgcgcctgtaatcccactactctgtaggctgagacaggagaattgcttgcttgagccccagaggtggaggttgcagtgagccaagctcacgccattgcactccagcctgggcgacagagtgagactctgtctcc

SEQ ID NO: 39549 - DNA, 507 bp, Homo sapiens
gggattacaggtgcctgccaccatacccagctaattttttgtgtttttcgtagagatggggtttcaccacgttggccaggctggtcttgaattcatgaccttaggtgatccgcccgcctcggcctcccaaagtgctgggattacaggtgtgagccaccgcgcccggccaaggatctgggccatttaagtggagtcttgaaggatgagtaggtgttaggcacagacgcacagaggcaggcaaagccacaggctgttggtttaggcaaaaattgagactggctggataaagtggtcttgggggaccatcaccagagaggaggcgctggaggtctgcaaggccttgtcctgcccctccaggggtagaggttccaggaggggctgactttttctcctggaagcctcacagaactgcagaccccacggatggcttggtgttgccaacatgaggcttctaaggcttctgcggggagatgggttggtggggagaagctgggggtggcagtggac

SEQ ID NO: 39550 - DNA, 437 bp, Homo sapiens
gttctcatttacaaatgggagctaaattatgagaacacatgaacacatagagggaaacagcagacactggggcctctgggagggtggatggtgggaggaagcagaagatcaggaaaaacaattaatgggtactaggcttaatagctgggtggtgaaataatctgcacaacaaatccctgtgacactagtttacctacataacaaacctacgcatgtgccattgacctgaaaataaaagttaaaaagattattaaaaatgtgtcagtaaaagtctttaaccaacacaagatggttcatcccaagagtcatcttaatttaaaaatcttcacatcttaagaagctacatgggaggctgcggcaggagaatggcttgaacccagcaggcaggggttgcagtgaagcgagatggcaacattgtactccagcctgggcggcag

SEQ ID NO: 39551 - DNA, 289 bp, Homo sapiens
caaagagaattagtcagcaaccttgtgagcagtgcggtccctccgtaggtggggctgcctgtgctcctgaggccccccaccaactccccactcagtgttctttgctgcacgtgatgccctagtagagggtcgaaaccaggctgcatcccacaggtggagggcaaggtcactggcatcaggccaagggtgccatgcacatgtcactgtgggcctcagagtgtgcatcactcgatggttagaagctgcagctcaggagtcacattcacattcagctcccaccccgtcatgt

SEQ ID NO: 39552 - DNA, 607 bp, Homo sapiens
acctctgcagttgaagtgattctcatgcctcggcttcctgagtagctggaattatggcacgcaccgccacgcctggctaatttttgtattttcagtggagatggggtttcaccatgttggccaggctggtcttgaactcctgacctcaaatgatctgcctgtaatccaaagtgctgggattacaggtgtcagccaccgcacctgtcctgacacgtgcatttaaagcaagaaacacacacttccaggacatagggctctgtcagcaataactgtcatctttgtatttgcagagatgtaaatatataagaaaccggctgggcacggtggctcacactggtaatcttagcactgtggaagactgaggggggcagattgcttgagtcccagagtttgagaccagcctaggcaatggagcgaaaccctgtctctactaaaaatttaaaatattggccgggcatggtggtgcgcgcccatagtcccagctacttgggagtctgaggtgggagaaggtacccaagcctgggaagtcaaggctgtagtcagctgtgttcatgccattgagctccagcctgggcgacaggagtgagaccctgtctcaaaaaaaaaa

SEQ ID NO: 39553 - DNA, 474 bp, Homo sapiens
acaatataactcttattaacgttattattgtcccaaatgttatcccgcatgggagagagtcagttctttctgtgtctgttatgatagccactagccttatgtggatatttaaatttgaatttaaatggattaaaattaagtaaaatttaaaattcagtctctcatttgtactagccacatttcaagtgctcagtagccacagataactagtggatatcagattggaccactcaaaattataggacatcttcattattgcagaaagttccattgggcagtgctgatgtagaatatataaagaattctcccagctcaagaataagacaaccaaccagtggtgtgctggagctgtctcatactatcttgagagtccattgttaaatttgcagtaattttgcaaattggttaaatacagccatttagaaaattatatcaatttaggatgaaataaagtatattgaaaacaaaactcat

SEQ ID NO: 39554 - DNA, 173 bp, Homo sapiens
atgtgtgtgtgaggacagagagaaggggagcaaagcttcagggaggtcttgaggtggaaaaatttgtgacgcacacgatttggtgactgaagaagaattctttcttgagggttctataacacaatagttacggtcaccctatgtgcatttaaaaattcctagttggtctcaag

SEQ ID NO: 39555 - DNA, 520 bp, Homo sapiens
gcgcacaccaccatgcccggctaaattttattttttatcgagacggagactctaccagagagtccccccacatgttggccaggctggtctcgaattcctggcctcaagcgatcctccgcctcggcctcccaaagcactgggattacaggcatgagccaccgcgcctgatttcagagtttttgaagcagaaagggaaacgtttccatctagagggagggcggacagacaggacgcctgggattctgggggaatagggtctgggctctggattttttaggtcctggagagtgacactcaagaaccgaaggggacagggtgaaggactgaggcctgggttccgagtggggcggctaggaaaggaaaaggctaggtgctccctgacccaggtcttctctacccgttgctttccagccatgcctccgccgcagggtgacgtgaccgccttgttcctggggctccgggcttggggaagtccgcgctgatcgcagcgctgtgcgacaaggatgtggagacgctcgag

SEQ ID NO: 39556 - DNA, 515 bp, Homo sapiens
aggagcccaggtgaacatgtccttcatatcagctaatccaagcccagagaaggtgaaagagtctcagaatcccatagtgggtcagaaattaagcccaaacagggtggctcacggctgtagccctgcactttgggaggccaaggcaggaggagcacttgagcccaggagttcaagaccagcctgggcaacttagtaagacaccatctctacaaaaaaaattttttaaatagccaggagccaggtgcggtggctcatgcctataatcccagcacttcggaggctgaggcaggtggatcacttgaggtcaggagttcaagaccagcctggtcaaaatggtgaacccccgtctctaccaaacgtacaaaaactacccaggtgtggtggtgggcgcctgtaatcccagctactgaggcaggagaattgcttgaacccaggagtgagaagttgcagtgagccaaaattgcaccactacagtacaacgtgggtgacagagtgagactctgtctcaaaaaaaa

SEQ ID NO: 39557 - DNA, 5986 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39558 - DNA, 1048 bp, Homo sapiens
  misc_feature (171)..(171): n is a, c, g, or t
  misc_feature (187)..(187): n is a, c, g, or t
  misc_feature (221)..(221): n is a, c, g, or t
  misc_feature (256)..(256): n is a, c, g, or t
  misc_feature (271)..(271): n is a, c, g, or t
cggcttcgggggaccgggctatccgaggccaaccgaggctccgctgctgcttgggcctggtatgtacagatggctggttaggattctcggcaccattttccgtttctgcgaccggtcggtgccccctgcccgggccctcctgaagaggcggcgctcagacagcactctgtnttctacagtggacacngatgaaataccagccaaaagaccaagattagatngctttattcaccaagtgaaaaacagtctctacaangctgccagcttattnggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggaggtaagccttttcagcttgatttctttaaaaaaaattttacagctcttcccaaggatgctgcctagagacactcagaatggttcaacgtttgacataccattgtaggttttcctacaatacagcctccaacaaaatgaggctgtcttaaacccagatgcaccaaaaatctgcatgcagcatgtgcccaggcagactttgaggggttcatgctatgagacctaaagttcttatgagattgtccagatcacattagcaaggcctatagcggccacgtgtgctcagtgagtctgtgacaggatcaagcatgttgcttatcgaggagcagaaaatcgttgtgaaagtattgaaggcacagacacagagtcagac

SEQ ID NO: 39559 - DNA, 991 bp, Homo sapiens
  misc_feature (114)..(114): n is a, c, g, or t
  misc_feature (130)..(130): n is a, c, g, or t
  misc_feature (164)..(164): n is a, c, g, or t
  misc_feature (199)..(199): n is a, c, g, or t
  misc_feature (214)..(214): n is a, c, g, or t
agcgtctctggcggtggtggttaagacggcgaaggcggcagcggcggcgacagctctggggtttgcgtctcggggtgtgtcggccgccgctgctgcttgggcctgcactctgtnttctacagtggacacngatgaaataccagccaaaagaccaagattagatngctttattcaccaagtgaaaaacagtctctacaangctgccagcttattnggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggaggtaagccttttcagcttgatttctttaaaaaaaattttacagctcttcccaaggatgctgcctagagacactcagaatggttcaacgtttgacataccattgtaggttttcctacaatacagcctccaacaaaatgaggctgtcttaaacccagatgcaccaaaaatctgcatgcagcatgtgcccaggcagactttgaggggttcatgctatgagacctaaagttcttatgagattgtccagatcacattagcaaggcctatagcggccacgtgtgctcagtgagtctgtgacaggatcaagcatgttgcttatcgaggagcagaaaatcgttgtgaaagtattgaaggcacagacacagagtcagac

SEQ ID NO: 39560 - DNA, 5931 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39561 - DNA, 5922 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39562 - DNA, 5932 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagatacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39563 - DNA, 2565 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggatttccgtgggtttgaggtcaaaaaatgtgggagaatgaaatgtgtg

SEQ ID NO: 39564 - DNA, 4797 bp, Homo sapiens
gggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggtgattgcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39565 - DNA, 4588 bp, Homo sapiens
gggaaaattactgatacagagacgatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39566 - DNA, 4247 bp, Homo sapiens
atggttttataagtatgttccatgatgtaaaaatgtcaacacttagaaaaagcacatggacatcctgctttattacatgattacacctgaaggttgtgctgccatgcacattaatatgtaatgcgggcgttgtttatggggttctttgcagcaccagatgcctctcttccggaagaagatggtgtgggaaatccttcatcagcagttgctgtgagaaaactttgcctggtccctctagctgctggtggttctttcacagacatttccatatacctcatgcattgtgggttaaaaagtccctgcatcacttctgttctcacaggtactgagctgtcaaaagtgcatgaaggcctctcactgtactctagtcctgacttggggtgcagagggctgcttgcaatcctgtttgtaaggctgtgcctgctcagagctttggactgttcaacccacacaagaacaaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39567 - DNA, 1958 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcagcaccagatgcctcttttccggaagaagatcgccagggttattccctctaatcacgaccgtccatgggt

SEQ ID NO: 39568 - DNA, 2104 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgacctaagaaaaaagtgtcttaaatatctggattctatgggacaaaagggccacaggatctgtgagattctccttcagtatttacaggatgaaagtaagaccaaaagaaatagtgatctgaatcttttagagtggacccatcacagcatgaaaccacacgagattcctcaacagctgaatgggagtgattgtggaatgtttacttgtaaatatgcagattatatttctagggacaaacctatcacatttactcaggtgagtgaagaccctcttcatccatttacttgttactaagcaagataaggcacttggccagtgcctggcacacattcagctctcaatagtagtagctggccaggcgtggtggctcacacctgtaatcccagcactttgggaggccgaggcgggtggaccacctgaggtcaggagttcaagaccagcctggccaacatggtgaaaccccatctct

SEQ ID NO: 39569 - DNA, 3820 bp, Homo sapiens
cggtggctggtacggccggacggtacgggataaacgctaactaatattttttttaagagattcttttccctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatggtttgaattaaagtagtagcagttagaatagaaaaggattatcagaatatgagagatgttaatttagaattaataaggcttgatcctctattggatatagagaagagattgcagtggtatggcagaattgaagatgatgcctagatttgaaggggaaaatataaggaattcagttttgaatgttttgaatttaataggttttatggaacctccaagtaaaaatttctagaagtcagttgcatatgcatagctgcagctttaggagagagatatgaactggaattaagaaattttgagttattcagcagatacatatttaacatttcttatgtgccaagcatgtaccaggcaccaaggatactgtaaaacacatgaaacctgctttatgactaataaaggagacagaaatcaatcatgaagatacataattacaaactgagacaagtgtcataaggaaaaattagaggttgatgtgagaaaattttaacaggaggaccacatctcattgagactgggggatcagggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtcttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggcccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggccaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactc

SEQ ID NO: 39570 - DNA, 1713 bp, Homo sapiens
ggtggcgggcgggggcctctggtagccctggggacgctgtatctgtgggctcttgaatcgcgtcacaaatcagcgaccgaactctggcggtggtggttaagacggcgaaggcggcagcggcggcgacagctctggggtttgcgtctcggggtgtgtcggccgccgctgctgcttgggcctggtatgtacagatggctggttaggattctcggcaccattttccgtttctgcgaccggtcggtgccccctgcccgggccctcctgaagaggcggcgctcagacagcactctgttttctacagtggacactgatgaaataccagccaaaagaccaagattagattgctttattcaccaagtgaaaaacagtctctacaatgctgccagcttatttggattcccattccagctgaccacaaagcccatggtaacttctgcttgtaatggaacacggaatgtggccccttcaggagaggtattttcgaactcttcatcttgtgaactgacaggttctggatcctggaacaacatgctgaaactgggtaataaatctcctaatggaataagtgactatccaaagatcagagtgacagttacccgagatcagccacgcagagtcctgccttcctttggttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggagggtgttcaaaaagaggaaagagagaagtaccgaaagttattggaacgacttaaagaaagtggtcatggaaactctgtctgtcctgtaacttcaaattatcacagttctcaaagaagtcagatggacacattaaagaccaaaggctggggggaagagcaaaatcacggagtcaaaacaactcagtttgttccaaaacaatatagacttgttgaaacaaggggacctctatgttcattgagaagtgaaaagaggtgttcaaaggggaaaattactgatacagagaagatggtcggaatcagatttgaaaatgaaagtaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggacatggaaaaggaaatcagtaatgccctaggccatggcccacaggatgaaatcctaagtagtgctttcaaattgcgaattactcgaggagatattcagacattaaagaactatcactggctcaatgatgaagtcattaatttttacatgaatcttctggtggaaagaaataaaaagcaaggctatccagcacttcatgtattcagtactttcttctatcctaaattaaagtctgggggttaccaagcagtgaaacgatggaccaaaggggtaaatctctttgaacaagaaattattctggtgcctattcatcggaaggtacattggagcctggtggtgattgagagggttaatggttaattgttggacttggataaaggccattttttaaaaataatgctgcctttttctgccctgtgt

SEQ ID NO: 39571 - DNA, 820 bp, Homo sapiens
tctcattagacatcagagaatccataccggacagaaatcttacaaatgtcataagtgtggcaaggtcttcagttagaggtcactccttgcaaaacatcagaaaattcattcctgagataattgttccaaatgcaatgagtatagcaaaccatcaagcattaattgacattagagtcaattcagcattgacttgagtttcagttgacttgacattgagttcaagcattaattgacattaaagtgtttacgttaagaggattgggctgggcagggtggcttatacctgtaatcccagcactgtgggaggtcaagacggatagatcacttgaggtcaggagtttgagaccagcctggccaaaagacgtgagccacttttcctagcctgttttttgtttctgatagggatttttatgggtattgtgttgaatctaaatcacattgggttatataatcatttaacaatattaatctttccaatccatcaatatgggtcatatctctatttatataagtttttaatcattttgatcaatgtttgtagatttcaaggtacaaacttctcacctttttacgtttattcctaaatatttcttactgtaagttctctagcaaatggaagtgttttcttaattttcttttaacattgtttattgttaatgtatggaaatttaactaatttttggtactgatattgtattctgcaaatacactgtgtttattagcttcagtagtattttagttgactctgtgattttctacacagcagatcatgtcatctacaaacaaatacaattttacttctttctttctgaaaaaaaaa

SEQ ID NO: 39572 - DNA, 264 bp, Homo sapiens
gtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcct

SEQ ID NO: 39573 - DNA, 783 bp, Homo sapiens
ctaagcctcccaaagtgctgggattacaggcttgagccaatgtgccccagccaatgatgaattccagccgtcccattttaaagatgagggagactaaggctaggagaagggaatgacggcctcagggccacaaagcttgggagtgcagagcccgagttcatctcaggcaaattcagaacaaactttctgagagaaacagtggggaaaacagtgggagtttagggaagatgggccatattgtcattggaatatccaattgtctgctatctgccaaaaaacaaacaaacaaacaaaaacccaaaactagaagagtataaaatccagtagaggaatcatgatttaaaactagggctctggtttaaagccataaaacctcagttcacactagcttaatgaaaagggaaagtcaagggggttcattagctcatgcatttattagctcatacccatgggatctcccaggcatgactgatccaggcctgggaccaggtaccatcaccagatctccacttctgcctcttggctctgccatgttagcttgattctccaatggagtggcaagaagagccaccaataccttcatacttacattctagcatgtagcaaagccagcagaatctcccgatggttccagctctcaagtacccagcattgggtgctatgtgcattcctaaccctgccatggtagccaaaagactcgaatgtattcattggccaggcctcattcacccacccagcctcggagtagggtcagttctgcacaaatcacacgcccgaacacaa

SEQ ID NO: 39574 - DNA, 202 bp, Homo sapiens
agataagaatcacacaaaggagcttttaaaagaatgttacctgggtcccatctccagagattatgtttcaatggatgtggtatgggacccagcattgttattttatttttaagagttccccagatgaggccaggcgcggtggctcacacctgtaatcccagcactttgggaggccaaggcaggtggatcacaaggtcgggag

SEQ ID NO: 39575 - DNA, 1009 bp, Homo sapiens
tgttctggtccctaacaatgctctactgtgttttccttgaatcttcatacagattctacctaagagtatctgctttatatttggagaaattgaatgtctaaaaggattaagcagaaccaaaattcagatccaggtttccatgccttgaatgtattgctttttctgttaacatggtattccccaaatagtactgaattctagaatcagctttaccagagtagtctggaggaaatttgcgaatagctctcttaaatatgcacggttctatgctcagaggagctcttctcagtattaatcagcaatccagtcatttttttcccctcatacttgtcattgtaagcacatttttctcaagctttactcagaagatcatccagagatattaactgttaacatgtgctgcaagttgaaagtgtttagagagaatatttgagtgcagtgtgacaaggataatcaagttgtttagggccagttggcgagaagactttggaaagcattgagaaaggaatgatgaatgtatgtgttcttttgtatctaaatccttcttcccttgtgtatgttcttcacagccttttctccctgaataaggatcactttgactttgtatgctaagtgtgccttcttaatggttcttttcctgttatctgaatcctgaagtatatttaaatgagaatttgatgcagttagttaattggaatataaaagactggttaacaaaagtcttcttaataatgaagcacaccagaaatggaagctgctggaaccagccatgtggacaaatgaaaaaatgccttttgtctacagattgcagcgatcctacataaatatatggaggtctctgtctggcttaggacagctggctaagtctgatcgttcccctccgtacagcctttaaaactgccactctaaatacttggtttccttgccattttattcagtatctgctggttatgagtactgtattattttttaaatgggcaaccaagtaaagttacctctgtatccgtct

SEQ ID NO: 39576 - DNA, 757 bp, Homo sapiens
cccctacatgaacaaacagatgcagaataattcccccccatcagtgcctagatacctccacacatccatacactgtgatgagacctagaatcatctagaacacctgcgggatgaagtgcagtggtgattaagagctagagggttgatatgtagtcttgccaaggcaaaaaacttctggtgcctcagtttccccatttataaaatggggtgatagtattgggttctcaaaacgttatcacagggataaaatgagctgaagtacctagagtgagcacaatgtcttgcacacaatgtctaggtgtttaatacgtgtaaaatgcatatccttatctctcgtcctccacgtcgtggtgggagagaagtggggagcgtgagtgttggggaggcgaagccctcgaggactcccgtgagctctcaaagaaagtgctcaaatggctactttctagtcgccaggtaggtacaggctagggaggggaggcgccggtggccgccctgaggtgacaataaaacatttatgctcaaggggaaaacacagcctgctgatatggcgtggagaccctaatagtgggaggaatgcaagggttcccggtgctagagagagaagggagaaagctttcagctgtgcatagggaactgaccagaagggggtgctgctgtctcccatcaagcatcccaaacaactccactgcttaagacctctctggcctacacatgaggtccctctctcctcattcaaattaattgtcttggcagccag

SEQ ID NO: 39577 - DNA, 527 bp, Homo sapiens
cccctacatgaacaaacagatgcagaataattcccccccatcagtgcctagatacctccacacatccatacactgtgatgagacctagaatcatctagaacacctgcgggatgaagtgcagtggtgattaagagctagagggttgatatgtagtcttgccaaggcaaaaaacttctggtgcctcagtttccccatttataaaatggggtgatagtattgggttctcaaaacgttatcacagggataaaatgagctgaagtacctagagtgagcacaatgtcttgcacacaatgtctaggtgtttaatacgtgtaaaatgcatatccttatctctcgtcctccacgtcgtggtgggagagaagtggggagcgtgagtgttggggaggcgaagccctcgaggactcccgtgagctctcaaagaaagtgctcaaatggctactttctagtcgccaggtaggtacaggctagggaggggaggcgccggtggccgccctgaggtgacaataaaacatttatgctcaagggga

SEQ ID NO: 39578 - DNA, 2174 bp, Homo sapiens
cccctacatgaacaaacagatgcagaataattcccccccatcagtgcctagatacctccacacatccatacactgtgatgagacctagaatcatctagaacacctgcgggatgaagtgcagtggtgattaagagctagagggttgatatgtagtcttgccaaggcaaaaaacttctggtgcctcagtttccccatttataaaatggggtgatagtattgggttctcaaaacgttatcacagggataaaatgagctgaagtacctagagtgagcacaatgtcttgcacacaatgtctaggtgtttaatacgtgtaaaatgcatatccttatctctcgtcctccacgtcgtggtgggagagaagtggggagcgtgagtgttggggaggcgaagccctcgaggactcccgtgagctctcaaagaaagtgctcaaatggctactttctagtcgccaggtaggtacaggctagggaggggaggcgccggtggccgcctagtggtggcctcagtggctctctctcccccgccccttctcctctgcccccttcacccgcgtccccccgtcctgtcccgcagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaagggga

SEQ ID NO: 39579 - DNA, 2034 bp, Homo sapiens
cccctacatgaacaaacagatgcagaataattcccccccatcagtgcctagatacctccacacatccatacactgtgatgagacctagaatcatctagaacacctgcgggatgaagtgcagtggtgattaagagctagagggttgatatgtagtcttgccaaggcaaaaaacttctggtgcctcagtttccccatttataaaatggggtgatagtattgggttctcaaaacgttatcacagggataaaatgagctgaagtacctagagtgagcacaatgtcttgcacacaatgtctaggtgtttaatacgtgtaaaatgcatatccttatctctcgtcctccacgtcgtggtgggagagaagtggggagcgtgagtgttggggaggcgaagccctcgaggactcccgtgagctctcaaagaaagtgctcaaatggctactttctagtcgccaggtaggtacaggctagggaggggaggcgccggtggccgcctagtggtggcctcagtggctctctctcccccgccccttctcctctgcccccttcacccgcgtccccccgtcctgtcccgcagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaagggga

SEQ ID NO: 39580 - DNA, 1964 bp, Homo sapiens
gggggcccttatggcgcggtgggcgtggacctggccttcgagcagctgctgtgccgcatcttcggcgaggacttcatcgccaccttcaaaaggcaacggccggcagcctgggtagatctgaccatcgccttcgaggctcgcaagcgcactgctggcccacaccgtgcaggggcgctcaacatctcgctgcccttctccttcattgacttctaccgcaagcagcggggccacaacgtggagaccgctctgcgcaggagcagcgtgaacttcgtgaagtggtcctcacaggggatgctccgaatgtcttgtgaagccatgaacgagctctttcagcccaccgtcagcgggatcatccagcacatagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaagggga

SEQ ID NO: 39581 - DNA, 2404 bp, Homo sapiens
cccctacatgaacaaacagatgcagaataattcccccccatcagtgcctagatacctccacacatccatacactgtgatgagacctagaatcatctagaacacctgcgggatgaagtgcagtggtgattaagagctagagggttgatatgtagtcttgccaaggcaaaaaacttctggtgcctcagtttccccatttataaaatggggtgatagtattgggttctcaaaacgttatcacagggataaaatgagctgaagtacctagagtgagcacaatgtcttgcacacaatgtctaggtgtttaatacgtgtaaaatgcatatccttatctctcgtcctccacgtcgtggtgggagagaagtggggagcgtgagtgttggggaggcgaagccctcgaggactcccgtgagctctcaaagaaagtgctcaaatggctactttctagtcgccaggtaggtacaggctagggaggggaggcgccggtggccgcctagtggtggcctcagtggctctctctcccccgccccttctcctctgcccccttcacccgcgtccccccgtcctgtcccgcagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgcggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggtcccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaaggggaaaacacagcctgctgatatggcgtggagaccctaatagtgggaggaatgcaagggttcccggtgctagagagagaagggagaaagctttcagctgtgcatagggaactgaccagaagggggtgctgctgtctcccatcaagcatcccaaacaactccactgcttaagacctctctggcctacacatgaggtccctctctcctcattcaaattaattgtcttggcagccag

SEQ ID NO: 39582 - DNA, 341 bp, Homo sapiens
gctaatttttgtatttttagtagagacaggttttcaccatgttagccaggatggtctcgatcttttgacctcatgatccgcccgcctcggcctcccaaagtgctgggattacaggcgtgagccaccgcgcccagccatgacctaagttttttatggtagtgatagtctgtgttgaaactcttagcatttccttagaactatttttattccaaggagaataaaatcttaatatataaaatgaaaatgacatttgggttctgtgaagtgtaaaacggacctcaaatcaacaaggggtcagataggagcaaaatcgaaaccatgtcaattgcatcctccatatc

SEQ ID NO: 39583 - DNA, 427 bp, Homo sapiens
aagaggtgtacagttctagaacattctgcaaccagacttcaggcaccaggaggcctccgtaggcagggttcctcgggcttctcagctggcttccttggagaaatttcatatgctgattcctttcaattatctgtcaattttcaaaatgcaaatagaaacatgcagtcatcactttggtactcaccagctgatttcttccaagcacccagaccataagtgaatgcagttcaatatgttctcttcctttttttaagtgggagttaatattactgagcagattttggttagcttccaggaacccagtgtgtggagaggcagaattttattttagaagcacaagttggtttgaaaaatgtgaacttaccccaactctttctttgtttcatctttcttactagacatgttttattttcctaaagaaaacata

SEQ ID NO: 39584 - DNA, 399 bp, Homo sapiens
gccattgcacctagccagcttttataggtatataaaaagcacttgctttcttttactcctagccaaaaaaataagatgcaagattaaaataagactcttttctattgacctagtagtattattgacactacataagaaagtataaaattaagctgaacaaccagggtgattcataactctaatacattgaaaatataaattaatccttacctattatatatttctgatcaaccttatcacttaaagcaagttttatgttttcaagtcttttcaaatgtacagtcaaaaacagctgacaggttttatacagaaaagtaacataaactactatttaacactggaaacttaaattatagttacatatatctacaaatactgcaaacatataaacagtttatg

SEQ ID NO: 39585 - DNA, 2255 bp, Homo sapiens
  misc_feature (319)..(319): n is a, c, g, or t
  misc_feature (372)..(372): n is a, c, g, or t
cattcttatttctttttttcttgaatttagaatattttctatttatatttaatagatccaaattaagtatgttgctattgtacccgtgaacccttaaaactgggataagccttgatgtgggtgtctgggaactctttaaacatgtattggcagtgtgcaccttttttttccttttgagtggatttgaaattgttcatttataaatccctttcaagcctccctggctgagatcgacacatgagaagttatttccaaggggtgtttggaaatggcagactctgcgcacaccatgcggcctctccctcaccccaccgcctcncacctcggcctgcctgtgttcccttctcttttgtcttgacttcctgagctgcngactcctggcatctttgactcccttttcttcgctccccagggcaacctggtatcctggagggcttcttgcctacccagaaagtatacccttggtaaaccagtggtgactgcccgagcatccatttgtgcaggaagcctcctgcctttcggtgcccgagaacctcttcagaagtctctcctttgagcatggaatatttatttgtgtggccatgcatatttgggtgccttcttaatctgtagaatggggctagccctgccagcctcacgggccatgcactagcatggtgtcatgtgaggtgttaataagtgttccaagggtaaaatgggttgctctgtcaagtaagttggcaagaacaccgtagcatactaaaggttctgtgatgcccctcagtaaaaacacttaactcaagtttcctgagcatgcttggcctaggaacacttctctttgtagaacacttgtgacaccttgaggtcttcagggacacactccagtgttattacagaccttgcatgatgtcatgtgagtcctggggtttggtgtcatcgagaagatgggctcccctgctttagacctctgtgtggacttactatgttcttaaatcacacctctttaacccaattccttctccctaacccagcagcctctcaaagttgctggcaaaatacagaaaacctaagtaaaggaggtgatggccacatctgccacacatctctgtgtactgctttcatttctttttgcttttctcttgctgttggtcgtgggcttggtttgacatgatcttattctgcctgagcttatgtcttccgtgttcccaggagtgtgtatttggcatagaatacgtacatgtggccccgcttttgtgcttatcttgccattttcccccttccattttgtaaaatgagaagatgttgagttctggggttgacatcagttgattaaaataaagaccttgccccaaacctcttttgcacatactatggtgtggattttactttaaaaaaaaaatggttgatttcttaacttgctattccttctgagcatggtagggtttggcttctgtttcatggcaggaagggctaaggcggctccactgaagttcccgctgcagtccacctggaggcccagaccctgctggggttcacgctaagcactttgagggtggtaaacagccattgtcttggacttccgtcctaaccctctcttctccttgtcccccttcttcccttccctttctcctgcaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcaggtgagaggtcccaagcacgtgtgactgtctcaggcagcagaagttacccgagccggcctcaggcttccccagaggagatgcaggagccgccagcggccacggaggaggaggaggaggaggaggaggaggaggaggggtctggtgagggcaccacgataagtcctgtaaacttggcacctttcccggaggcagagttttgggccattctcacctctgttccaggcaccatccgtagtggttctctgtctgtagcttccgctcgtctgtgtgggtgatgattaaagcattctcattgcacagttctgtttttaaatacagagtctgatgcctcctatttgtaacaatgggtgtagctcccctgcccatcttggaggtgcatggcccaccagggatctttaaagtgggagcaggaaaggctgct

SEQ ID NO: 39586 - DNA, 411 bp, Homo sapiens
tctaacatctatcaaaaggtaatggaacacatttttaatttggaaatagacacacggtcttttatttaccgtttttgttgaaatttaactgacataattgtatttatcatttactaatatttactttgtaaatggcttaaagatttccatgttgttgctgtaatcataaaatccagaaaggtcatattagcaaatttttcattcattagtctttaagtgtgtcagttggtactgactgcagactgacttatgaataccaattaccattatttctatttattcatgttaaagtatttacttgtaataatattttgtgtgctacatcattgagtaaatatttcacattaagataaatgctgtaacattagtatgccactaaatttgctatactctttaacctaataaagaaca

SEQ ID NO: 39587 - DNA, 520 bp, Homo sapiens
agagttaattaggtaaaagcacatcttttccctccctgggactttagaacttaaatgaggaaatttagtataaatgctcataagacaaatacactatagttttcataggtggtcaggaatttttggtaagttggggttgtatcttctgtttttaatttatgactgattttgtgcgtttagctgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccacgcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccagaaacctgcagtcaatatgaagaaagatgaatgtttgaattttag

SEQ ID NO: 39588 - DNA, 528 bp, Homo sapiens
actttcttaaagtatttaaataataaattaaaagcattatctctaaataattgaagataaatatgtattgcattttattacaaatcaaaggtataaaaatgtggataataagtataactttttgcacaatgcaaaatttaaatatttagctgagtaagttggaagaggaaggtgggaggaaagttatgttagtacacagatttatctcttaacagatgagagttaaagacaaattgataaatcaaataaatgagctttacatatatttaacaataaaaatacatcttttaaaataacataatcttaaattgaatgaagaagcagaaggagggaaaattaaaaatgctaatttttatttttgctttaaaaaagatgtaataggtgctgtaaaagcagtataggattctgatacacaaagttatggttacagaggtaaataggtaataacacttaaaactgctatagaacaaaaatgtgatgtggttgtaagtaaatgctttacttcatctaatcttcatttttaaaaga

SEQ ID NO: 39589 - DNA, 676 bp, Homo sapiens
  misc_feature (48)..(48): n is a, c, g, or t
  misc_feature (97)..(97): n is a, c, g, or t
  misc_feature (99)..(99): n is a, c, g, or t
tttcttcacttatatagcagatatagactgtcatacatgtataggacnaggctcattaagcttctcagatgtatcagatagaagattacctaagatntnagtcatttacagatatgacaatgctcagagaactatcttgtcctgtctctactcaggccccctttctactattaactacagataaaagtgctaaattactgaattcaattaataactactccatactcacttcatcttacttgaagagtcacacacttctttataaagaattccctgagactgggtaatttataaacaaaagaggttcaactgactcacagttctgcatgggtggggaggcctcaggaaacttacaatcatggcagaaggcaaatgggaagcaaggcacatcttacacggtggcagaagaagggggtggggaaaatggccaaacacttttaaagcatcagatattatgagaactcactcactatcacaaggacagcctggggaaaactgtccccattatccaatcacctcccaccaggtccctccctttacatgtggggattacaattcaagatgagatgcgggtgggtacacagagccaagccatattacttagattttcagttacgcaaaacggatgttcatagttgtatgtgcctaaatatagctttagagattcaataaaatt

SEQ ID NO: 39590 - DNA, 926 bp, Homo sapiens
tggaaactcttcatatcaactagttaaataaattcaggcaccttcacacaaggtaatactaggcatattaaaaaaagaacatggtaaagcaaatctgtacctaaagtagatctgtgtattagtctgtttttgcaatgctgataaagacatacccaagactgggtaatttagaaaggaaagaggtttcattgacttacagttccacgtggctgcagaggcctcacaatcatggcagaaggcaaggaggagcaaagtcacctcttacatggatggtgacagtcaaaagaggagagattatggcagggaaactcccctttttaaaaccatcaaatctcatgagacgtattcactatcatgagaacagcatgagaaagacctgtccccatgattcaatcacctcccaccaggtccctcctacaacatgtgggaattcaagatgagatttgggtggggacacagccaacccgtatcaatctgtatgtctgatatggaaagcattccaagatacaaagtttagtgtttgtttaaataatgacacaagaacactctttaccatgattccattttttaaaatttatctgtggtcttcaaggcaagatgaatacaggataggaagggagatgaagaaagagacttattgttcatgttaaaaagtcggcttgagtccaggcatagtggtttacgcctgtaatcccagcattttgggaggcagaggcaggagcatcgcttgagttcaggagttccagaacagcctgggtaacgtggtaaaaccccatctctacaaaaaatttaaaaattagctgggtgtggtggtgcataactgtagtcccagttactcaggaagctgaggtgggaggatcaattgagcctgggaggtggccaaggctacagtgagccataattgtgccactgcactctagcctggg

SEQ ID NO: 39591 - DNA, 431 bp, Homo sapiens
aaaaaatcatccacacacagatttgcctataatcttatggacttcacagacatcctcaagcgcatggacaaaaaccccaagattcaagaaaagccgtccacatggtcggcagctcaagaaagcctgccagttgtccaagcaatgcttagttacagttcccatgctgggagctgctctctagagaaatgttatttgcagatgtgcacctcgtgcgtctgtgtgtgttgttctgcctgtgtccaaaatacatgctttttctagatgggagcctttcccccacaaagcagaaatgtgttctgtcatgggatttgatgatcatcaaattactttccctcaagaattggctttcttggcgattagttaattcagttttcaaaacttttagataagggcttaatcaacgtaaaactgctttggggcagttgcattgt

SEQ ID NO: 39592 - DNA, 587 bp, Homo sapiens
tcccttctcccgccaggcatgggctgcaacgagtgtacgcacccctcctgccagcactcgctgagcatgctgggcatcggccagtgcgtggaatgtgagagcggggtgctggtgctggaccccacctcgggccccaagtggaaggtggcctgcaacaagtgcaacgtggtagcgcactgcttcgagaacgcccaccgcgtgcgggtgtccgccgacacctgcagtgtctgtgaggccgccttgcttgatgtggacttcaacaaggccaagtccccactcccgggcgatgatgagcagcacatgggctgcgtcttttgtgaccccgtcttccaggagctggtggagctgaagcatgcggcctcctgccaccccatgcaccgcggtggaccagggagaaggcagggtcgagggcggggccgggccaggaggccccctgggaagcccaaccccagacggcccaaggacaagatgtcagccctggccgcctactttgtatgatgaccctgtcctccctcacccaggctgcagtgccatgcagacacctcatggcacttcaaactattaaaatgcattttatcttatccaga

SEQ ID NO: 39593 - DNA, 522 bp, Homo sapiens
cattgaacagatcatctaggtagaaagctaacaaataatcatcaaatttaatctgtaccacagaacaaatagacttaacagacatttacacaacatttcatccaaaagctgtggagtacacattcttctcctcatcacacagaacattctccaggctagaccatatgttaagacacaaaacaagtttcaacaaattttgaaaaatcaacattatatcaagtatattctagacaaaaatagaatagaactagaaatgaatactaggaagaactttggaaactatacagataacatggaaattaaacaacatgcttctgaacaaccattgagtcaatgaaaaaactcagaagaaaataacaaatgttcttgaaataaatgcaaatggaaacacaacataccaaagcctatggaatacaacaaagacagtgctaagagagaattttacagcaataaatgcctactgcaagaacatagtaagattataaacaagctactatgcacctcaaggaacaaaaaaaaaaa

SEQ ID NO: 39594 - DNA, 343 bp, Homo sapiens
aaaattccatattccagtatctgattaaaaactatcaataatttattgcctaatataatttgaagcttaggcataagttaaaaaactctcctgtcaaattccaaaatatcttcatttgggcttgtcacaagtcttaatttccctgggaatcaaattacaaataaataaaaagggaaggaaaatacctcactctcacttttcagttcattagatattaaaataagagtgattcttctaaccaacaccaaacaactaaatgatacatacagcaacttctaagcagctgctttttcttcacctcatcatcttaaaatcaggttggttttctaacttctttccccat

SEQ ID NO: 39595 - DNA, 376 bp, Homo sapiens
ggccagcaggaggcctccaagcattgaaactgccccacccacccaagggcttaatttagacccctcgacaggttgactctgccagcatgatctgacccatttcatttcctacatgtagcaagtaagaaaaagaaatggaaatattcccttctgcagactggtgtgaaatctctagctagacttttctaactgtaaaaacagtcagtgggcctagaaatgataatacatgcaaggttttggaaaaaccaagccgagagtccatacactcagatccttggacctcagcatctgtccggccgcccctccactcctaaaagcctgaccacccccaccagcccctgtcacagctgccccaacagctcagccacccaccttc

SEQ ID NO: 39596 - DNA, 538 bp, Homo sapiens
ggccgggccggataattgcctataaacacactctgttatcttggcttcctagtgacttccatacgactctactcacagagtatttttcttgctgctcatcttactattttcatggataaattggagctatcagtttctctatagttctaactcttgacctttttcttactggttcagatggctagcaagctcttaaatcatagttttaaaattattcatttccacccatcccagaaagttctgtttgtcatctctttcctattaaaaaaaaaaatcttcagtttagacaccctcaggatttagtatttttttcttttgaatattcttattctacttagtatgtatagcagcacgctagattattagacatggtctagcagtctttatggtttgggaatacctcaggatatttccaattgtctcaaaaggtatccctacaatttcaaatttacgataacaaatgactaaaaattcacatttttttaaaaagagccattcccaacaaaatgaaattccataaaaactttaggagaaagaa

SEQ ID NO: 39597 - DNA, 441 bp, Homo sapiens
ccttttataatttaaatgccttttcattcattttacattgtactctccagtgtttgaaacctctctgtgtcattattttcctttttctctttttctgaaaacaccataatagcttttttgaagtttaggatgagtttcttttaataatcttttagcagggtgcagtggttcacacctgtaatcccagcactttgggaggttgaggtgggtggattgcttgagcctaggagttcgagggcagcctgggcaacatggtgaaaccccatctctaacagaaaatacaaaaattagccaggtttagtggcatgagcctgttgtcccagctactcagaaggcagaggtgggaggattacctgagcctagggaggtggaggctacagagttcagatggtgccactgcacgtcagcctgggtgacagagtgagaccctgtcaaaaaaaa

SEQ ID NO: 39598 - DNA, 2311 bp, Homo sapiens
cacaaggctacaggtgtctttatttccactgcacgctggtgctgggagcgcctgccttctcttgccttgaaagcctcctctttggacctagccaccgctgccctcacggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcggcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctctggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatgtgaattactgtaaaataatctattttggattcatgtgttttccaggtggatatagtttgtaaacaatgtgaataaagtatttaacatgttaaaaagtc

SEQ ID NO: 39599 - DNA, 2460 bp, Homo sapiens
ggctgagtggtttgctccttcccctctctctgggaggctgagcaggggtgccgggttgctcaggccatgggagccacacctgttattgctgcctctgatttgtgtgacactgagaagcccacaggcctgtccctccaactcggtggaccctctctgtgtgcatttggtgtgtgagccagctctgagaagggttcagaagccactggaggcatctggggacctcagcttccatgccatctctgcctcactcccacagggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctacggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcggcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctctggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatgtgaattactgtaaaataatctattttggattcatgtgttttccaggtggatatagtttgtaaacaatgtgaataaagtatttaacatgttaaaaagtc

SEQ ID NO: 39600 - DNA, 478 bp, Homo sapiens
ctgctgttgtttatttctctaaaaaatcacattagaaatgagcctccaaggagcttgacttgaacctggaactttctaaaatgcagagtatctatgcatctctatctacatgcatgcctcccttccccccacacacatgcacacacacgaacacacgtgcacatgcacacacacgtgtgcacacataacccttctggacttagcagcacacggaccagctggatgcttgtggggcctgagggtggacagctcctccacgccatcagggctgctgtctgagacctgcccccaagagcctctggccaggacgcagccttcccccacacatcacaggcacagggaggcatttggagcgcccgaggatagggctgtgtgacatccctggcaagggccaggcagcgggaatccagccgccaaactcgagggcctcatggaatgctaatggctacggacagcactgccacaggcttgagtgaca

SEQ ID NO: 39601 - DNA, 387 bp, Homo sapiens
tactactaaattcgcggccgcgtcgactcccttccccccacacacatgcacacacacgaacacacgtgcacatgcacacacacgtgtgcacacataacccttctggacttagcagcacacggaccagctggatgcttgtggggcctgagggtggacagctcctccacgccatcagggctgctgtctgagacctgcccccaagagcctctggccaggacgcagccttcccccacacatcacaggcacagggaggcatttggagcgcccgaggatagggctgtgtgacatccctggcaagggccaggcagcgggaatccagccgccaaactcgagggcctcatggaatgctaatggctacggacagcactgccacaggcttgagtgaca

SEQ ID NO: 39602 - DNA, 552 bp, Homo sapiens
aattacggaacaggcaataaataggcaatggccctgggacttcctgctcaccgtacctgtaccaacagcctgactgggccaggctttccactggtgcagttctcatacctgtcactgccaagaatggctctttttgaagtgaggctgctgagtctgggagcatcaagagtgggagggaaagcatgggcttgctatagccatgtttcagagcaaagagcacagactggggtttggggcactgattagtctgtcagtgtttattgtggttttgccaattacttttccccttgggctttagcgtcccctatttatctgatggaagagtgggatgaaatcagagttgttacctgatattcaacacatgaattctatttaatttggccagcacagtcactgtccttctcactctcactctctcaaataggattggctgtcaacatttaaatatcaagatttcggagcggggcgcgatggctcacgcctgtgatcccagcactttggcaggccgaggtgggcagatcacgaggtcaggagatcgaaacacagtgaaac

SEQ ID NO: 39603 - DNA, 496 bp, Homo sapiens
cagctacagggagggccattaagatggcacagtcatggagtaaacatatcccccttgccaggccacctaagcacagttcctctgtcgtctggggaccacgtggttattcagctggagtgggtttcgacattaataactggacattttttggctggtgttaatccatctaagccagttcctgtgagccctgtggccactaagtaaataccctttttcccaaagcgcttcactgtggcccgatgggtctgagtgtgtagtgtgcacaggtggagacgatggaaaccacaggggctctgtagtctgcagcattcttgtcttcaaagactttcagaccagtgaaaaggtaaagcaggtcagataagaccaaagaaggttcttgcagaagggtcctggttcttggacaattctgagaagtcagtttccctccctcatttcacctcctcatacatccagagatacagttaggcagatacagggattttctggggaatatttt

SEQ ID NO: 39604 - DNA, 460 bp, Homo sapiens
cccagggttaggggaataagtgcctcctttgctttggaagaagcgacccttttatttagtattaattcgagttatcagtcctggacccactgctcacaacgcccaaatgctgactgggaaaggtagtgggtaagaaccccaaggggcaggcgggagagtaacacagagtccaggtctgggtccttgggctgcttgcctcgctcttccgaaaagttgtgcctgggacagagacagggcggaatcctcgcgaccagccccggggatcgctggccaccacaaatgagatgaccgacatagggggccctccctcccagaggtgctaggtggggaaaagccaaactgttaaaaggcgagaacctcctttcctggggccaacgcgatccccactcatgctgcgttttctggcggcgccagccgaacccagtgactgtgaaacccaagttgggggacccggaaggcg

SEQ ID NO: 39605 - DNA, 6788 bp, Homo sapiens
  misc_feature (140)..(140): n is a, c, g, or t
ctagatataatgggaggtgctttatagaaagtgcagcatatcctttgtctgattccaaacaaatgtagaagtctacgctagctagtagtaatggcagctgggaggtgcaggttctctccacccaggctcattttccacgntttgggtcatgggggacagctggtcctggactgtggcactaagaaagcatgactcctgccccgtcttcccttgaggggcagaacagggcagagtctgcacctgtgcccgtgcccagcatcacgcccaccccgctgcctttgcaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacggtgaggctcgctgcgcactgtgccgcgtcttctgctggggggaagcgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39606 - DNA, 656 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctgaggcagccacaggttttcatctggccttggtgctttggattccccagaagtgaattcctgatttctgccggaagaaggggaccctcccca

SEQ ID NO: 39607 - DNA, 598 bp, Homo sapiens
ttcacgcctttattgtagaaatgccataagggaagccccgtggtgaccgtggttttaagccttttgtcgtcttcgtaaggagcataccctggtttatctctagaggctcatgaaccatctgtctctgccaggcagcctcatctgtctttttggaggatgcctgagctttggaactgcaaagaaatgcgcctttttatgcctcctgacagtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccagggtgagggcagtgactttgggggagacaaaatccaattgcacctaacctgacatgtcacgcttgaccctttagtggccatcgtcttgtggaatttcatctttggtgtcttccctcctcacaatgtctaaatagcaccatggcctgactctcaagaatgctgcctcgcaagtaactgacctttttcctttcccagatgt

SEQ ID NO: 39608 - DNA, 591 bp, Homo sapiens
acccccctcacggcctgcggtctgggctctcggcaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccagggtgagggcagtgactttgggggagacaaaatccaattgcacctaacctgacatgtcacgcttgaccctttagtggccatcgtcttgtggaatttcatctttggtgtcttccctcctcacaatgtctaaatagcaccatggcctgactctcaagaatgctgcctcgcaagtaactgacctttttcctttcccagatgt

SEQ ID NO: 39609 - DNA, 684 bp, Homo sapiens
gcttcttatttacactctttgtcccaccttttctcagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccgagatccttggacccagtgtagttgcgctttacttgccgcttgccacagatcttgcccc

SEQ ID NO: 39610 - DNA, 610 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctgggtgagtccgggccgggggcagcgacgcccggaggagagggcgcccgcattcgcccagcctcgggaagacgggtacccccccttcccgaggggatcgggcggcgctgggactgccggggcgtaggggtcgcgcgcagaggggtggctgtttgaatgaagtggggctggggactcgagagagcactctggctgggccggtggcgcacggaggccggccgcccctccacggggatctccggcccgcgccgccagaggatatggttgctggatagccggctggggcgctttgcgtattcatgaggatcccggggtgttgacttagccggcctgaccctgtgcctggcgccttttcttttgcacctgttgatgaaaccagtgattgccctttggtttgtgttggcgg

SEQ ID NO: 39611 - DNA, 7385 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39612 - DNA, 7246 bp, Homo sapiens
cgggtgtgaatgaacaggaatgagcaggagacgctcgctgatgccttctgtgatgtgtttcttccccagctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39613 - DNA, 7389 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacggtgaggctcgctgcgcactgtgccgcgtcttctgctggggggaagcgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39614 - DNA, 5746 bp, Homo sapiens
agcatcagaaagggggcgagcttaggggcggcattcctcttggggtgtgggtgtgggtgtttggatgctggaggaactcatcttttccccagcttgtggttggcctcatcttaccacctgggcctacccatggcttttgaatttccaccagcctttcggcgagctggcagcaggcgttgaactgacctccccactgagcccctgggtcccgggaagggcctgtgcctgccaagagcaccacgggtacacccctgcagcacctggagactaagactatgctgcccataatcctcttctctgactttcagaagatgtttaggtccctgtccctctgcttgtgttatttgggcagcttggcagtgtcctaggttagcaggtgaagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39615 - DNA, 6478 bp, Homo sapiens
ttccagctaaagcacgtcctgcggcgagtcaccttggttagccgcacgggtcaagctctgcaaggagcttgccctcctcgtcctcccttccctctgctcccctcaccgccctcccctcctcttttcagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39616 - DNA, 4559 bp, Homo sapiens
tggaactctaagaagaattcccctttaagagaattcccgccaaagggccaaaattggcctgggtaaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39617 - DNA, 7332 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacggtgaggctcgctgcgcactgtgccgcgtcttctgctggggggaagcgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39618 - DNA, 4131 bp, Homo sapiens
ctagaggatcccatggtagcgctaccatggtagcgctcgggttaacatggtggaatctcatctctactaaaaattttaaaaattggctgggcgtggcagtgctcacccgtaatcccagctactcaggaggctgaaatgggagaattgctcgagcctgggaggttgagactgcagtgagccgtgatcatgccgctgcactccggcctgggtggcagagcgagagcccatcttaaaaaagaaaaaagaaaaaaagctgggactgaatctagctgattactcctgaaatacactgaattagtaaatgacacttaggatgtagactgtctaaggacgaaatcatgcagtgaattgccttgtcctttacacttcagccatgtggttttatgtttcaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaagggaatccgtgacccacagagctagacagataagatgcatagttgaccagtcataaaaggcggtgtttaggtgatcaggatgccgttggtggcatttacgtgctttatatgatttttacctccgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39619 - DNA, 5698 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacggtgaggctcgctgcgcactgtgccgcgtcttctgctggggggaagcgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggaaaaaaaaaaaaaaaaaaaaaaaaaaaaaaaaaaaaaaaaaaaaaaaaaaaaaaaaaaaaaaaaaaagaagaaaaaagaagaaaaggaagggagaggagagaaacagaaaaacaacagaggaaacaagaacaacgacgcgatagcaagcgggagcgcgcccactctccgaagcagaggagtaaccgcgtaggcagcgaaagagataacacaaaacgggagacatgagacaaagaagctgggggcaacacaacaaggaggcggacaccgcggcgacaacc

SEQ ID NO: 39620 - DNA, 3662 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacggtgaggctcgctgcgcactgtgccgcgtcttctgctggggggaagcgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggggtctcggacagtgaactcgggggagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagatcgtattgagaaggcagtcagttttcgtacaggctctcaggatg

SEQ ID NO: 39621 - DNA, 3305 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacggtgaggctcgctgcgcactgtgccgcgtcttctgctggggggaagcgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaagggggatattcttgcagcacgatgatagactactcggcggatctctagactcgccggatcctctagctgtctaactctaccttaagttctatcgcgtgttaccccccggacgcttaaccgctgccctataagcc

SEQ ID NO: 39622 - DNA, 2052 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacggtgaggctcgctgcgcactgtgccgcgtcttctgctggggggaagcgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccagggtgagggcagtgactttgggggagacaaaatccaattgcacctaacctgacatgtcacgcttgaccctttagtggccatcgtcttgtggaatttcatctttggtgtcttccctcctcacaatgtctaaatagcaccatggcctgactctcaagaatgctgcctcgcaagtaactgacctttttcctttcccagatgt

SEQ ID NO: 39623 - DNA, 858 bp, Homo sapiens
  misc_feature (3)..(3): n is a, c, g, or t
  misc_feature (6)..(6): n is a, c, g, or t
ggncgngcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactcccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39624 - DNA, 466 bp, Homo sapiens
gtctgcgttccatcaggaagaagatagatccaattaaaaaaaattaaaaccaatttaaaaaaaaaaagaacacaggagattccagtctacttgagttagcataatacagaagtcccctctactttaacttttacaaaaaaagtaacctgaactaatctgatgggaagaagacgcatcttgctccccatcaggattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 39625 - DNA, 219 bp, Homo sapiens
gtcggcctcctgtgctcagatccgtgtctgacacgctcacgtgtggaacagaccattgtactcatgccccgccatgtcctccagatgacgcggacctggtggagctcaagcgggagctggaagccgtcggggagttccgccaccgttctccgagcaggtctctgtcggtccccaaccggcctcggccacctcaacccccgcagagacccccccctccaa

SEQ ID NO: 39626 - DNA, 428 bp, Homo sapiens
ggcaaagccaaaaacggctctcagggcaaggcttcctgggctcaattcatgaccatgggctttgggaccaggggaagctaaagatcatcatcacttctgcaaaacagcggacctcgaagacgggaaacaacaaggccagaataggagcgagaagagatgaacttccctctcgaagtggttctctgagccccccggtaagagaaataatgaaggaggaagcgagagaggattcgtggtgtgtttagtaaaacaaggaagggctacagatacgctggaacaaagcctcagagcttgctttccaagtagcagtccagatacacaaatgggtcagctctgactgtgtaggcatcaccccttaggaaacctgaccacagaatgcccttgcaaagaaacggagacaaaaatagagtccttccatcctgcagtgg

SEQ ID NO: 39627 - DNA, 420 bp, Homo sapiens
gacggcccctcccttttcctcttccatcatagctgcctgcctgtccttgggaagcatctgatttgcaggtacctgggtttcccagcccggcgcttgctggctgcaagatagtgtgattgtcgcactgacactgcacaggctgcaagctgaggggtcgatgtggcccaggaagggcgggccctgtgcagcttccctggctatggatgaaggtgcaggctgcggaaggcacgactgttcctgcagggaatgcgtctcactggagaagacgaggtagcaggggaacagttaccaccttcaagcagagacggagccttggcagggccgcccaggggagccgtgtcggaatcaaatgtcctgacagcctagagagccagccgtggtgtgctgggctgtgcattttaggagaaagttagtacagcc

SEQ ID NO: 39628 - DNA, 460 bp, Homo sapiens
taacctctgtataggactgtcttaaactgtctctcatgcttgcaaattttagttagtaaattacatttattgggagtggggaaaactaatcattttttatatacttatctttaaaaataatttctccaggcctagtaattctggcaattctggttccttttaccttttcttaggatacaaagctgccactagtatgtttgtgttcaaaatgtagacttcatactctgcaaaaattgatcaaaacctgtgtgcctgaacagtttatctgcctttaccccagaatatttttggagtacatactttaatttcttcttatttcttgattattcttctcaagagagagaggattaaaaattgctttgagactcccagcgggcactcctcatagtagcccaaggagaaatgtagatttgttcatggtggaatcactcaaacgttaagttgctaattataaaaaggg

SEQ ID NO: 39629 - DNA, 225 bp, Homo sapiens
tactaaaattaattgtgctatggttatgaaataggatattatacagtcattaaaacagtcgaagacattaaaaactcataatttaataagacagtaattttaaaaactgtatatataatatatgactcccattctgggaaataaaatacatgtatacgttgctaggagcataagaaaggtgtgcagagaggtatcaatcagggtctcaatgagaaatatagtgat

SEQ ID NO: 39630 - DNA, 375 bp, Homo sapiens
atatggcttaggaagtgggggcctaggatctttataggttttggctctcgggaggctttgtttgggagtgtgtgggtctctgggtaacagagagtaatactggtgtgttttatcctttggggccccctgttggaaggtggataacataattttcattttttctttttgcttctcctcatccctccttacacacactttctgagcttctctaagaagctcgttcgtgggatggtccttccaatttcctatcttttgtaatttccttgtgatatctggctgttagtaacaaaatgaagctttaacattcactgcctaagaggatcttctaaatctaggccagcatattttctcatttgttctttcaacctgtctaaa

SEQ ID NO: 39631 - DNA, 316 bp, Homo sapiens
gacacaaaagaccccattatacctgagtacaataaatgcactttaaaatagagataaaggccagatgcggggctcacgcctgttatcccagtactttgggaggccaaggctggcagatagcttgagtccaggagtttgagaccagcctgggcaacactgtgaaaacctgtctctacaaaaaaaatacaaaaaaattagctgggcattgtggcacagcccatggtcccagctacttgggaagctgaggtgggaagatcacttgagcccgggaagccaagcttgcagtgagccgagactgtgccgctgcactccagcc

SEQ ID NO: 39632 - DNA, 474 bp, Homo sapiens
gccagcaatgcatttactgcctttggaaggaggcatttcaggggtgcagcatggtagaagagaggtgattcagtctgctattcttgtcaatgcaggtgaaaagcctaatgctatttgctaggcagaagagaccttatctctgaaatgcccttaataggatatctctggctaaggattactatggtaagtagaacacgggatctctgaggcacagatggcttcctggagaatgtcaatggagctatccaaatctctggggtgtaaaatgaagatatttgcaatgctcccctttgtgtgtggaaacccacaaaccccagtataaacctcatctattctgggccagaggtgcatttctgaggcagtaagaagtgacgtggggggctgcccttcccttctctgcttcacttgagccttctgactgcctgtatccttgagattatttagtaaagcttggtactagttaagaagatctct

SEQ ID NO: 39633 - DNA, 309 bp, Homo sapiens
gtgtaatgaattgataccattttgagagcagctggataatgtaaagaaacaaactgagtttaaattaatttttagttgttcaaagttgaaaactttaactggaaatacttctgatcatagtgtgacatgaagttaatatttttacctatgaaagtggttacgtatatatatatacacatatatgtatagactgttacagataattgtataaatttgcttgtggagctagtctatatttgaagttatttgtctctgatttctgattttcaaagcttaatgagagttcttctagaaataacccagccccca

SEQ ID NO: 39634 - DNA, 414 bp, Homo sapiens
ctagtatcaccctacttgacagatgagaaaactgagacccagagagtgacttgcccaatatcacacagctgttaactgacaggactgggatttgaactcagctcatgctcttaaccaccacaagtccccaggctggaaactgaaaaagttggggggtcaggttgctgcgagtacctaatgggaaggagtcacagagagacatgagtgaagacttggggacagcagtcctgggaaagtcaatgagggctgaaaatttggagttgccccaggagagagggcagaaaaggggataaccatcccccagcactccctgcccccacagcccagacttgaccaactcccagctgggcctgggacttccagatatggggccccacccttgcaggccttggggacgctgaagatattgactat

SEQ ID NO: 39635 - DNA, 215 bp, Homo sapiens
ttattctataagcttttccttttaacattttttatttttttactttttaaacttttttcttaaacatacacattagcctaggcttacagagggtcaggatcatcaatatcactgtcttccacctccacatcttgtcccaatgcagctggcacctcctgtgatcgcaatgccttcttctggaatccctcctgaaggacctgcctgaggctctttta

SEQ ID NO: 39636 - DNA, 396 bp, Homo sapiens
cccaggtcaggcctcacggtggcctctccaggatgagctcctgccctccgatggcatctccaggccccaaatggtctccggtcggtgggctcctccacgccaaggttgggcctcccggcgaccgcccaggccaagttgtcctgaagtcgggctctcccggctgcatctccaggccggactctggcccgactccaggtcccaacaacgtctttggactcagctcctgcccagctcccagcggccctggtaggcccacaacttccctaagccaagctccccaggcccagctcaggcctcgcggtggcctctccaggctcagctcctgggccctccgatgacatcttgcaggccccaaatggcttccggtcggtggggttcctctaggcccagcttggg

SEQ ID NO: 39637 - DNA, 280 bp, Homo sapiens
aaaacaaaaaaattcaattttttttcaaaaaaaggtacttatgaagaatgagacaaaaaccaaaactgatgaaaataaaagatctagatgataaatgatagaaagcagaaaaggaagcaaaataaaatggaaacacataaagtatttaaaagtattagagaaaaaatgagactcttatatacaatcagcaatctaagagccacagagtagtttttcccaaagaagaaaattaaaataattatacagaagtttataaatgtaattcaagtaaatatttcca

SEQ ID NO: 39638 - DNA, 406 bp, Homo sapiens
gcctcatatcatggcccagagtgtaactgaaattatgaaagcaaggaagtccattcaatggtgagccaacagagctagcagtgccttggcatcaacgctgccatgagtttgtgccttcattacacaaatgtcctcttcttggagccacgttattatacaatatgtgtccttaaggccttcaattaacatataaccttaagttcatagttttaagttcttaaatatgtttgtatgtttattgttatcatcttatactttgatttttataagtatatatcacatatattatatagtatatataataaatgtgtatatatatttctatatgtatatagtataaatatatgcatataaaatttgcaaacttttataaccttattctagaatttcacactggcataaaatg

SEQ ID NO: 39639 - DNA, 624 bp, Homo sapiens
agagagagctgaatggttggtctgaaagatctgtatgacaggggtgagcatagatgacaggaagttgttttccttccacagcacattatgcttcgaatctctttctgtggagcattaaggcaatgattgaaatctgatgctctgaggaaacttttggaggggatgggtatattcactatcttgattgtggtgatggtttcattggtgtatacatatgtcagacttatcagattgtacactgtaaatatgtgcacttgattaaatgttaaacctcaattaaaaaagaaaagaggctgagtgtgttagctcatgcctgtaatccccagcactttgaggggccatggcaggtggatcgccgaggccaagtttgagaccagtctgggcaacatagtaagaccttgtctctacaaaaaaagtaaaaacaaaattagcccgatgccctggcaagaacctgtagtcccagctatttgggagactgaggtgggaggatcacttgagcctgggaggtcaaggctgcaatgagctgagatcacaccactgcactccatgcactccagcctgggtgacagtgagatcctgtctaaaacacacacatgcacacatataagcacacacacaaataaa

SEQ ID NO: 39640 - DNA, 808 bp, Homo sapiens
cacaggtagtattacatgtctagtcacttgctatatatctatatttcttcactattcagtgtccacaccccttatttgtcaatgagatatttctttgctagattttaagttctaagagggcaaggactgtgtgttaaacaagttcagtgcaggttagaaggcaagcccagcaggtacgtgctgagtaatactttcctgatgttttgaccaaccacatgcaagctcttttcatataattaggatgaatctaattttaaaatgagcaaccgcgtgtcctcagatgaaccagaatatacacttacaaggccctgctgtcctgcattataaataagggaataggttgtcctgcagaaaagctctgctgttttctttttccgtaaaaaaaaaaaaaaaaaaaaaaaaaaaacagaaagaaacgcatccacacatataaaaactgagatagacgatcttctcaattcctcaactaagttgggaagaatcatggccccaaagtggatgttctctgcaaagatgaaacctagcaaaaatccacaatctgatgatttgtaaggaaacttgcttaagaatggcttacggcaaaaagacccagagcttggcagcctgattcttcaacttgtatggcagcaataacttccttaggtgacaggttcaaatttctgcagggatgatattgtgagactgttcagaaagtgtcaagctccatcgctttttaaattttcttttcactgataggaggaactcactggacacagagctcctgtggcagctttcacaatgcctggctttctttggccttttatttctt

SEQ ID NO: 39641 - DNA, 128 bp, Homo sapiens
tagcactttaaagttgtcattccattactatctattttgcaatggttctgataagaaatttttaaaaaaattgttctcttgtatgtgacgtatcttttattttgtctgcttttaagaggtttttattt

SEQ ID NO: 39642 - DNA, 539 bp, Homo sapiens
cggtgtggctcagtccctatgccgtgtgtccctgtggggccctccagcagtcctctgtcccaatctggcaactccatacatttgcccacatggctctggatttcggatgggtgtgtgtgtgtgtgtgtgtgtgtgtttgattgagtgttctcttgtcccctccttcatggcccctcactatagagcaagcttgtccaacccgtggcctaagggccgcatatggcccaggatggttttaaatgcagcccaacacaaattggtaaactttcttaaaacattaagagatttttttgtgatttttttccagcttattagctatcgttagtgtgttagtgtattttacgtgtgagccaccgcgcctggcctgagtgttttattggattacattaaacacatgtattagttgtcagaaaaatgacatatttacattcccatttgggaatttgatctctttctctgttattcaagccttttatatcctttggtgacctgttttttccatctacatagttctcattaagttcctagtatttacagat

SEQ ID NO: 39643 - DNA, 788 bp, Homo sapiens
cggtgtggctcagtccctatgccgtgtgtccctgtggggccctccagcagtcctctgtcccaatctggcaactccatacatttgcccacatggctctggatttcggatgggtgtgtgtgtgtgtgtgtgtgtgtgtttgattgagtgttctcttgtcccctccttcatggcccctcactatagagcaagcttgtccaacccgtggcctaagggccgcatatggcccaggatggttttaaatgcagcccaacacaaattggtaaactttcttaaaacattaagagatttttttgtgatttttttccagcttattagctatcgttagtgtgttagtgtattttacgtgtggcccaagacaattcttcttccaatgcggccagggaagcgaaaagattggccacccctgccatagaggtagtaaatagggacagaggttagtactggggctgggcgtgctacttgcaagtgattcgattgcaaatccaccaccttcccacagctgaaccatgactccccataaataccaggggaagtcgaccctcagtgatcagaggacctctgatccttttcactgatctgggtggtcagaaacccccaaaagccttgagaaacactctgagtcctttggtcatttgcagtcagcttgcagtcaccaggcctcccgttctcccttccatccttagagcactccacggctacctggctactgtcacacatgcagggtgaagggggagagcacctctcagaacccaccggtcagcactgccacagccttacgactccagagt

SEQ ID NO: 39644 - DNA, 831 bp, Homo sapiens
tccatagcaacaaataccagccgatgccagttattctcaagtgtgtcttcccatccctgactccaccagtctcctgttctgtacttccaattgcctactggatctctccttttgaatgttgcgtaaactcagtgtgtctcaaatagttacccaacccaatcctccacactgaaatattttctggcagtgctacaccttttgcagtgatactgtctcaggcactcacacagctgcagtactctaatactctgccactggccccttggcagtcgacaagagccagtgatgttgggaacagaaaagaagggatagacattagaatcatgttacatgatggagaaagggttcaagataagtatcagtgcaggacaggacttggagaatggttagttattggaatgaatggcaaatccaacaatctgaagacaggagcagtttgagcaaaggtgatcccaggactttcagcctgtcctgcatgtttctacggtttcgtctacagtgactggatcagttctggagtctcccagttctcattatccacctgggggctggggataagactccagagagtcctaggacaagctggcctttgggaatgcagtagatagttctcatttctctgattcactctttaatttattgaataaacactgtcaagtgcttcttatgacaaggcactctgctagatgctatgtgggacataatgaagtttacagctttaaaaaaaaaaagtcattattttggccaggcacgatggctcacgcctataatcccaacactttgggaggccaaggttgggggatcacttgaagccaggagtgaaaagaaaga

SEQ ID NO: 39645 - DNA, 708 bp, Homo sapiens
  misc_feature (672)..(672): n is a, c, g, or t
  misc_feature (674)..(674): n is a, c, g, or t
gaagaagagaagaagggggctttatttgtattttttaaatgttctgcttggagataattacagataagcacacaattttaagaacttatgcagagataccctcacccagtttcccccaaaggtaacatcttatgtcactatagcacaacattacaaccaggaaatcagtgatacaatccatagtccttacacaggtgccgtcagttttacatgcactcatttgtgtgtgtgtgtgcatctgtgtgtgcatttaatttgatggaattttgtcacatgcattgattcatgtggccaccaccacagttaagatacagaatagtttcatcacaaggttcctttgcactaaccttttacagctacacccacctgcctctcccccaatctcacctctgacaaccactaatctgttctccatctctataattttgtcattttaagaatgcaatataaatggagtcatacagtatgtaaccttttatgattggctttgttcactcaatagaattctctggggcctcatccaagtggctgtgtatatcagtagttgctgagtcctattccataatacagcactatggtgtgtttagccattcattggttgaaggacatctgagcggtttccagattttagctattgcaaataaagctgcaatgagcattcatatacaaaananaaaataaaaaattcacttgccatcccttgtacat

SEQ ID NO: 39646 - DNA, 210 bp, Homo sapiens
ggatcatcagctgaagacagaggtctgaaatcactccaaactcatgtagtaaactcaaggtttttccatttggtcaggagaaaagcaaatgaagaaagaatccctagcagtaagcaagcaaaactaaaataaaagaggggaacggataatgaacgggagccagggagaatgatacagaatgttgctataacaagtaggttaacactttgc

SEQ ID NO: 39647 - DNA, 440 bp, Homo sapiens
cacctcagcctctcaaggagctgggactacaggtgtgtgccaccatgaccagctaatttttgtagaaatggggtttccccacgttacccaagctggtctcgaactcctgagttcaagagatccaccggccacagcctcccaaagtgttgggattacaggtgtgagctaccgtggctgactgaagtttaccaatttacatgttaatctcatccaaaaccactctccaagctgacacataaaattaagcatcatactacctcctaggtctgctgtgtttgcctgacacatagtgtgggctgtgtacatgtttgtgccatttttatgactgggaaaatgacagtgatgatgaggattcctagttctattgttactaataccgctatggagtctgaagtgccaggttttaaaacccaggtgtatcgctcattagctgtgtgacc

SEQ ID NO: 39648 - DNA, 427 bp, Homo sapiens
aacagtccccggtgctttgcaagggttcagattgcagaacagtcacatatgggtatttgtagttataaatacttgaccgttctctaggggtggggtttccaactctttaaacaaccctgttgcctgttatcaagctgactttttgctccaagtgccagaattgattgtggttaggacatcttacgctgagaaataaataaaatggaacataatgggtctgcttcaaatgctgataaaatccaccagaatcgcctgtcgagtgttacagaagatgaagaccaagacgctgctcttaccattgtgactgtgctggacaaagtagcctccatcgtggacagtgtgcaggcaagccagaagagaatagaagagagacacagggaaatggaaaatgccataaaatccgtccagattgacctgttgaagcttt

SEQ ID NO: 39649 - DNA, 374 bp, Homo sapiens
aacaatggataacaatttagtataagtatgccccatgcaactcaaatttaactgggcattttgtaattttatttggtatatgtggcaaccctaatccctatacatgcatatgttcatatctgtgtaacatagttcttgggctaaatagttactgacatctgtagtaagcctcagtacctttcattcctaaaaccccagttcaaactggaaccagatcattgtttctgtcatcattaccattctagagaagtacagggattatcttcccttccacccctggctcaacttgtgggaaaaattcttgtacttacacaaatagtttcaatttttagaattattactgggaaaataatccaaggttcattaaaacccac

SEQ ID NO: 39650 - DNA, 366 bp, Homo sapiens
aacctccccagtaactggcacttgtggtagattgattccatgtcccatgttcttagatcatggcttaagtcctaagacaactcaaagcttcaaccctcaagctcttgaatctgatcactgaaaagtattctgttagaccatacatgtattaatccagtggaaaaggccatcttgcttttacctgctcttcatttagaaaactcctttctctgaacagaagtccaatgtcaactaataagagtatggtagtcaaccatgttcacagattcattagctcttgctcaaatttattccttgcatctatgcaataataaacacctattatgaaactcccaaacaaatattacctacttaaatagtccctag

SEQ ID NO: 39651 - DNA, 453 bp, Homo sapiens
cttttgctcaggtatcttctcaatgagctgatgactctacctaaaacttcgtagtgccctgcacacctccctcctcacagcactcttgatgcccttacccggcttcacttgtgctctttctccacaccattctcctttgtatataccttgtaattgacacatttgttgtgtttattgtctttttctccctactagaatgggagttccacaagggcagggagctgtctgttgttcactgatgaaagcaaagtgccttgaatagtggctacttcaagaaatatttattgaatgaaaatttaaaaacagcctagaagtgtttccactatttctcatatgagaatgccaatgtcatgaggaccagttccatgagtattttgttaattactttatatccaatgcccagcaaagtatctgccattagtaggcacttaataaatgtttgtgaaatgaata

SEQ ID NO: 39652 - DNA, 629 bp, Homo sapiens
ttcaggcagttagagttcaaccagtttaaaagccacatagctcatcgtggatagaaggactttaccatggtatataatgggtgttctttctgtctttagttttttaagtagagatagggtcttgcagtgttgtccagactggtctcaaattcctggcctataaaaggaattattatttttatttatttatttattttgtcagccagctggagtgcagtggcgcaatctcggctcactgcaacctctgcctcccaggttcaagcagttctcttgcctcagtctcccgagtgtctaggattacaggtgcccaccatcacgcccgtccaattttgtgtttttagtagagatggggtttctccatgttggtcaggctggtctcgaactcatgacctcgtgatccgcccaaagtgctaggattacaagcgtgagccaccacgcccggcctgtaaagggaattcttaatccagagtcttgggtctctttaaattgtatgcattcttaattttgaatgtgaatatgcacaattttcttgggaggtggtccatagcttttgtcagatactcaaaggagcccatgaccccaaaaaggttaaataaaagctaacgtttaaaaatattttggtatatatt

SEQ ID NO: 39653 - DNA, 341 bp, Homo sapiens
ttttacagataaagtataatcctttcccttgatcacctcaaatatttgaagataagtctcatgcccaatactgtaataaaaactaatgtacacaaaagtacaagctcttcagagacagcagtaagcactcaaagtgttgttattattagtactatattattttaggcatgaaattgtcatcaaaagaacctttaaaaagttaaaaagcactgcttcaaatctaagctaaaagcagacaggataatggttatccactggggatgggatgtaactgtaagggaataccaaggggacttcagggagaatattctgcttcctgatctagatgctgaatacacatg

SEQ ID NO: 39654 - DNA, 326 bp, Homo sapiens
ttgagacagagtcttgcttagtcacccaggctggtctcgaattcctgacctcaagtgatccacccatctcggcctcccaaagtgctgggattacagacgtgagccactgcagccggcctattctttagcaagaaaaatgaagccaaaaagaagcaatgataacaaccaggcgttgcgatgagccgaggaggtggaggttgcaatgagccgagatcgtgccactgcacttcccgcctgggtgactaagcaagactctgtcttcaaaaaaaaagaagagaaaaaaagaacatactgttttatgtttgtgagggtctatgatgttattt

SEQ ID NO: 39655 - DNA, 492 bp, Homo sapiens
cttaatcagtgaaatggtgctgaaaatggaatacttcaaaagcctgtcttaaattttaaagtaaatgactttaaaaaataattttttttcaattgggccagtcatctgaaacacaaaacctgagacgagggaaatgtgcaaatactgcgtttgtgagaagagcctagaatgctagccattttacaccccacgtgacttcttgccaacctgcttcaattctcactgcttggctccaaatgttctggaatcaatgggattacagacgtgagccactgcagccggcctattctttagcaagaaaaatgaagccaaaaagaagcaatgataacaaccaggcgttgcgatgagccgaggaggtggaggttgcaatgagccgagatcgtgccactgcacttcccgcctgggtgactaagcaagactctgtcttcaaaaaaaaagaagagaaaaaaagaacatactgttttatgtttgtgagggtctatgatgttattt

SEQ ID NO: 39656 - DNA, 1715 bp, Homo sapiens
  misc_feature (1)..(1): n is a, c, g, or t
  misc_feature (3)..(4): n is a, c, g, or t
  misc_feature (110)..(110): n is a, c, g, or t
  misc_feature (121)..(121): n is a, c, g, or t
  misc_feature (123)..(124): n is a, c, g, or t
ngnncgagcgcaggagacacaggcgctggctgccccgtccgctctccgctccgccgcgccctcctcgcccgggatgggcccccccgccgccgccggatccctcgctcccngccgccgcctngnnctgccgcgctcgcactgaagcccgggccctcgcgcgccgcggttcgccccgcagcctcgccccctgcccacccgggcggccgtagggcggtcacgatgctgccgcccttaccctcccgcctcgggctgctgctgctgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctagctcggggcgcccggctcggggtgcgagagtgccagttccagttccgcttccgccgctggaattgctccagccacagcaaggcctttggacgcatcctgcaacaggacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggccgtgcggagccacacgcgcaccgagtgcaaatgccacgggctgtcgggatcatgcgcgctgcgcacctgctggcagaagctgcctccatttcgcgaggtgggcgcgcggctgctggagcgcttccacggcgcctcacgcgtcatgggcaccaacgacggcaaggccctgctgcccgccgtccgcacgctcaagccgccgggccgagcggacctcctctacgccgccgattcgcccgacttctgcgcccccaaccgacgcaccggctcccccggcacgcgcggtcgcgcctgcaatagcagcgccccggacctcagcggctgcgacctgctgtgctgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccaccagggctggacc

SEQ ID NO: 39657 - DNA, 1014 bp, Homo sapiens
tgatttcctccccctgaacttgcggtctccttttgtctgcattttcctctcttcctttcacctcccattcccaatcttattttctgtccatccgctgggcccttccctgcaccccctacctgtccacatgcgtccgcccctctgcctcccgcaggccgtgcggagccacacgcgcaccgagtgcaaatgccacgggctgtcgggatcatgcgcgctgcgcacctgctggcagaagctgcctccatttcgcgaggtgggcgcgcggctgctggagcgcttccacggcgcctcacgcgtcatgggcaccaacgacggcaaggccctgctgcccgccgtccgcacgctcaagccgccgggccgagcggacctcctctacgccgccgattcgcccgacttctgcgcccccaaccgacgcaccggctcccccggcacgcgcggtcgcgcctgcaatagcagcgccccggacctcagcggctgcgacctgctgtgctgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccaccagggctggacc

SEQ ID NO: 39658 - DNA, 1537 bp, Homo sapiens
cattaggctagtacgaggctggtgtgaatcggccgaggacgatgctgccgcccttaccctcccgcctcgggctgctgctgctgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctagctcggggcgcccggctcggggtgcgagagtgccagttccagttccgcttccgccgctggaattgctccagccacagcaaggcctttggacgcatcctgcaacaggacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggccgtgcggagccacacgcgcaccgagtgcaaatgccacgggctgtcgggatcatgcgcgctgcgcacctgctggcagaagctgcctccatttcgcgaggtgggcgcgcggctgctggagcgcttccacggcgcctcacgcgtcatgggcaccaacgacggcaaggccctgctgcccgccgtccgcacgctcaagccgccgggccgagcggacctcctctacgccgccgattcgcccgacttctgcgcccccaaccgacgcaccggctcccccggcacgcgcggtcgcgcctgcaatagcagcgccccggacctcagcggctgcgacctgctgtgctgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccaccagggctggacc

SEQ ID NO: 39659 - DNA, 180 bp, Homo sapiens
attctaagaattatttggtggagtctttaggattttctgtatgtaagatcatgtgccaggcatagtggtgtgcatctgtagtcccagctactcaggagcgcaggagactaaggcaagaggatcttgagcccaggagtttgagaccagcctaggcaacatagaccccatctctataaaaaa

SEQ ID NO: 39660 - DNA, 521 bp, Homo sapiens
ggctgagctgctacaggggcagagggtggggtggggttgggtgggagaatcatcccggcacttcatcgtgcatgctatttcgggcagcatcttttttttttattttattattattttttttcctgatgcttgagttatgaatgaggatgacctctgcaatcatgatgtctcccatagactctgttccttgttcctttgccagctttctcatgcatggtcctaacacttccatgatttaatctgctgcagaccatagtcttcagccacctcagcaataacttgttagaacattaaaaggaagtaaattgagaacaacttgttgccatcccattttcattagaaatcagacatcttagagatgtcaagaaagcagctagcagctagggggtatggggacctgtcctgctcacactgctgtgtgtcagaccagacctgatcctggagctcaggaccctagagagccctgatctctggaactcttgccacgttgttgctgaggcagctgaagtccccatctccca

SEQ ID NO: 39661 - DNA, 204 bp, Homo sapiens
aaagggcagtcaaagagattcaaagcacaagaaggatttgatgcaccatggctggctttgatgatggaggggctctgcccactgatcagagagacgtctttaaaagctgagagtggtccctgctgacagtcagcgagggcacgtgactggagtcctacaaccacaaggaactgaattctgcccgtcacctcaatgagctttcaa

SEQ ID NO: 39662 - DNA, 531 bp, Homo sapiens
tctaaaaaatagctctaaaacagtggggcagactttcaaataaacatactaataattacatgtctaggaggcccctgtctccttcaaagcagtcacctaggaaggctacacatttgttccagtaatgcttctatggcttaaatatgttgtggaatgcctctgaaatgctaagaaataaaggtgaaatgacattattttaagtaacctgaattgtggcagaggtgaatttaattttgttgagtagtcaaatcatcccaggaccaagtgtagtaaataaaatctgcagtgttgtttggagccatagttggatgtaaaataacaagatgggctttcctaatgatgcataaactaactcttgaaattgtcaaagagggattccagaaccctggaccttggaataaatgtataagctcccaaggtagctactgtgaagaacagtacttgtctaggtaaggaaaaaaatatgtgtatgtttgcaaaataagatcagttttattactttatagacaaaccttgtagatgaaaaaaaaa

SEQ ID NO: 39663 - DNA, 514 bp, Homo sapiens
gagacagggttttgcactgttgcccaggctggagtgcagtggtgcaattgtggctcactacagcgtcaacctctcaggctcaagagatcctcccacctcagccttctgagtagctgggactgcaggcatgcattaccatgtctggttaatttttgattatttgtagagacagggtctcactatgctgctcaggctggtctcgaactcctcagctcaagcaattttcctgccttggcctctcaaattgctggaatttcaggagtgagccactgcatctggcaacactgcttcttaacttgagtagaatcttcctgcctagacagaagtgaatgggaaagcttagtgcatcttagagtatcttctaagagaaacttggtgtgaaaccatggggaataaagcccagtacttgacatgggattttaattcatttacttgatatgacatagtgggtgatgcaaaataggtacctttttcttcacctttttccacagtgacttttcactttagtttgctt

SEQ ID NO: 39664 - DNA, 550 bp, Homo sapiens
gtggaatttattaacaaagaggagttagtaaacggattcaataaatgttaatgtataatgcttttgggattcttgttttaatacatgataatctttcacatatactccataaggaggatcacttataggagattagactaaataaaatcagagatttctcatgaccaagttatgggattcttaattcatcatattatttataaagttttttttttctaagtagttcttaaaggaagggtataattttagtttattcattctgaatcctgagcagaagcagcacactaacataagttttatgaaagtgtcacaatctaacctctggaaggaaaacttataagttgaagtcctttgtgtaatttgacattgctgtaaaattgagctgagtttggagtgacagctccatgaacgcaggggcgtggcttcttccccatgtactccagcacctagacagagcttggcatgtgataagtttcaagcgagtgttgaatgagtcaatgaatgaacaaatgcatttacctctgaatcacttctctgtcggcttttgtta

SEQ ID NO: 39665 - DNA, 696 bp, Homo sapiens
cgctgaagccgttaggatgagccctctccttccagagctttaaccgatgaaggtgcattgtgtttggcgcccctgaggaggatgctgtcttaggcctcttcccactggacgtgtgtggtgggcagagatcccgttcgtcggtcgcacttccaccccgctggggctcactcaggccgcggagctgcgagggagacatcctcgatggactccctctacggagatctcttttggtacctggactataacaaggatgggaccttggacatttttgagcttcaggaaggcctggaggatgtaggggccattcaatctctagaggaagcgaagaaaatttttactactggagatgtcaacaaagatgggaagctggattttgaagaatttatgaagtaccttaaagaccatgagaagaaacatgaaattggcatttaagagtttagacaaaaataatgatggaaaaattgaggcttcagaaattgtccagtctctccagacactgggtctgactatttctgaacaacaagcagagttgattcttcaaagtgccatgcctgttgttcccactgagggcacagaccatgtgtatctggttaacagttctatgtccaccacgttgcaataatggactctcagaaaatattgaagaatatgttaaagaatgagtagaattatgctactgaaaagggtgagtggaag

SEQ ID NO: 39666 - DNA, 436 bp, Homo sapiens
ttagttttagagtcagagacaggcctctaaaatcatggcaatactccctctcatcattatatatatttttcaacctttctatattttattttcaaatatatcttcttgcagttagaaagggtattgaaaaagattgtgtggttgttctagaaaaagtaatagtaatatgccaccagcattttatatcattctgcttttatttttaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacaggtaattgttatcacccgtggaatttattaacaaagaggagttagtaaacggattcaataaatgttaatgtataatgc

SEQ ID NO: 39667 - DNA, 4725 bp, Homo sapiens
taaatcagtttcaagatgattttactaagcaggcagcccttaatttacaaattctagattcatacatatcttaaacatacaaaatgatatgaggagaggtaagttcagggtctgagttcctggctgttgttggaactgatttctgtgtagtgattcagaagatgtgagacaccctaatttacaagtacagaggtatcttcttttctgcaaacagcagtacaacaatagttcctcttacgcagctgtgaatgaacaggattattacaattaatgatatctcatttgattggcgccttagagaattaagacctttcacacctaatatacaactttgttgtgaaggcagatatttatattctcattttactgatgagagactacccggagacgctatgtcacacctgaaggattaggtactttctctgttaagtccaatgttccttccgttattccatgctaggcagtaataagttctgtcttgcctgagtaataagctccaaacctcggaactgcacccatcttgagaaggaggagggcgctgtggttttttctgataagtgcagctggcagacactctatacgcttaatcacgggcaaatcctagctaagctgcctaccaaactagtccttcttttccccgttgcccacgcagatggctgttgatcttttctgcaacaaatccaggagtttctcctttttgttttataattgctccaatagatgctttaggatttaactctctgctttttaaagcagaatcgccatcccaggtgtgcaaccacgaaaaaattagacatccgtgagagacaatgccctccatggcccagtttccaggcagagagaagcagctctgggctgaccgccaaggctccggcccgagagggtctttaagtggagtaaccagtcttcaagaccccgctcccaagccaccgacgcgctgacgctgcagccctggacctgctgggggcctcttcctcggacccgcatgctgacagcgggactggcaactgggcagaggtcgaccccgggtccgcacagcacctcccgagacccagctcccagctccctcacttccggctctctggaggcgggcccggccagtgccgccgaggccagcgcggcgagctcctccccagcagcggcgggacggccacaccctgcgctccgcgcgggctcgggtggggtctccgctcctgcgccctgcgccctgcgcgccgcagccgcaaccccgacggcgccccaaacgctgttgcgccgcgcgccccgcccagcccggcctcgcgctggtcccggtctcgccccgcagccctcgatctcccgtgacttcctcggccaggccgcctgcgcctctgggaccatgttgcgctggctgcgggacttcgtgctgcccaccgcggcctgccaggacgcggagcagccgacgcgctacgagaccctcttccaggcactggaccgcaatggggacggagtggtggacatcggcgagctgcaggaggggctcaggaacctgggcatccctctgggccaggacgccgaggagaaaatttttactactggagatgtcaacaaagatgggaagctggattttgaagaatttatgaagtaccttaaagaccatgagaagaaacatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaattacttgttttccagtttttattttttttagagaaaattcttaagtctcagtttcctaattgaaaaaaaaaaattataaataaagcaaaaattgtatcctaca

SEQ ID NO: 39668 - DNA, 3512 bp, Homo sapiens
cgctgaagccgttaggatgagccctctccttccagagctttaaccgatgaaggtgcattgtgtttggcgcccctgaggaggatgctgtcttaggcctcttcccactggacgtgtgtggtgggcagagatcccgttcgtcggtcgcacttccaccccgctggggctcactcaggccgcggagctgcgagggagacatcctcgatggactccctctacggagatctcttttggtacctggactataacaaggatgggaccttggacatttttgagcttcaggaaggcctggaggatgtaggggccattcaatctctagaggaagcgaagaaaatttttactactggagatgtcaacaaagatgggaagctggattttgaagaatttatgaagtaccttaaagaccatgagaagaaacatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaattacttgttttccagtttttattttttttagagaaaattcttaagtctcagtttcctaattgaaaaaaaaaaattataaataaagcaaaaattgtatcctaca

SEQ ID NO: 39669 - DNA, 348 bp, Homo sapiens
cgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagacagccaagcttccttgcatttcagttggtcagaggaaccaaggactaaggtgaaagtggcctccatcagcgtcggcactgctgactggtttgactcctgggagcagaatagggatgaagggacctggcagcagaagactcccaag

SEQ ID NO: 39670 - DNA, 414 bp, Homo sapiens
tccagtgtagagatgtattgggctactgagactaggcaggtgctatatctctttctagaatattctggacaattgtgtggcataagaatcaggttgttcttctttattaccataaaagaagacaaagtacaagggcagtcatttgttggttcagtgattcaggccttggttactcttgcttgactctatgttctactttacagagcacggctcagtgggttctttgtggctccagagacaaataattacactttctggattcaggcagacagccaagcttccttgcatttcagttggtcagaggaaccaaggactaaggtgaaagtggcctccatcagcgtcggcactgctgactggtttgactcctgggagcagaatagggatgaagggacctggcagcagaagactcccaag

SEQ ID NO: 39671 - DNA, 438 bp, Homo sapiens
gaggaagactcctggagctggtgaactgtgcatggatatgcagtcacgggcagcccacctcctactcctcaccctccctgtgcctgtgagggtctgcactcaccctggtcttgctttattgcccaggctggagtacagtggcgcaatcacggctcactgcagcctcaacctcttgggcccgagcaatcttcccaccttggtctcctaaagtgctgggataacaggcatgagccaccacatctggctgaggccccacattttcattttgtgctgagacttgtaaattaggtagctggtcctggctgtagcagatggtatagattctttttctggctctgtttttgtgacatctcaacttactgggctcttattaaaggtgatttaggtgacttatcaacttttcatgagtacagatgaagaactcttctagggcagggg

SEQ ID NO: 39672 - DNA, 394 bp, Homo sapiens
atacaccatgttggccaggctggtctcgaactgctggcctcaagtgatccgcccacctcagcctcccaaagtgctgggatcacaggtgtgagccaccacacccggccagtttgtgactttttatacctgtttctcaactatcgctctcacctcctcagtgtgggtcagactttgaaaattgacagcctgcaggccgtgtttggttctcacgcctgtgcagtgagctttttgcttgctttatttgaattagttgccagcatttaaaagtgggagattccgctgggcgtggtggggtgcgcctgtagtcccaggtactcgggaggctgaggcaggagaatcgcttgagcccaggaggcagaggttgcagtgagtcgagactgtgccactgcactcc

SEQ ID NO: 39673 - DNA, 628 bp, Homo sapiens
cgtggaacatgtaccctgcagataaaggactattctatagacaaaccatatgcagcccatttttccactaatgaaagttcagattggggccaggcatggtgctcatgcctgcaatcccagcactttgggaggctgagccaggtggatggcttgagcccaggaatttgagatcagcctgggcaacatggtgaaaccctgtctctataaaaagtaaaaaaaaaaaaaaaaaaaaagtcaagtgtggtggtgagcacctgtagtctcagctacttgggaggttcagggtggagaatagcttgggcccaggaggttcaggctgcagtgagccaagattgcaccactgcacaccagcctgggtgacagggtgagacctgtctcaagaaacaaaaaattcaaattattttaccaataattatacaccaaacagttttgttgtacatatattgttgcatgttgtacttttatatcaataaagtaggtggagtcctaccagttgaattccttgcctacaacatagtggatttaaaatatattcattaatgccttattattgtctgaaatcattaatcttaatgggaatttatgtccatttcctgacaaattcaaccaggactgaacttttttttat

SEQ ID NO: 39674 - DNA, 347 bp, Homo sapiens
gatgcagctagaaggcccttaccagctggccgtctagatgctagtgccatgtccttggacatttcagcattcagaaccatgagccaaatcctgtaaatctttttctttatcaatttcccagtctggtgggaattctgttatagcagcagaaaacagactaagatgtactgctactgttttgtgagcttgagcttaccttatttttttataccttgagggactatagtgtattctggatagattgatgagctgtcatgagaaattttgttaaatattttatagatacacatttttgtctttatctgccagttgtatcaatttgaaatgactgacttcataaatgtatt

SEQ ID NO: 39675 - DNA, 489 bp, Homo sapiens
gtagtttgagagacatgttagctgagggagaagagacaggatatttgcaaaattttgtagcttgaaaggtcaacagcatcagctacttccagcatttcaattgcaagggtagattcattgtcaatgtcatagtttagttgctgagctttacataggactagtttgtactggtaactttgatgagtttagtgagaagaggcaacaacaggaaaaaaatacctcaatgagaaacagcttattaaattaataccactcaaaacagatttatattgcaggttttaagcaaatacagttgttttaaaagcaagaggttcaactgtattcttgttgatattgattaatatgtagggaaataaaccaaaattacatgttttccatgagaagaatcatattttcagtgagaagaattacaattttctagtaaaaaatatcgaatttctgttttaaaagataaattgtgccttttttttatgaactatatgccattgg

SEQ ID NO: 39676 - DNA, 468 bp, Homo sapiens
cacacacacacacatacatgatttatatatcacagcaaaaagaattagaaatgcttttctttacttagatatgtctatagacgttttggttcatgtgatttacagtggtgatttttagaaacacaaagctggaatatgcttttatagttgagattaagtttaaagctatgttctcagtaaaagtctatcccgggccgggcgcagtggcttagggtgtaatcccagcactttaagaggccgaggcgggtggatcacgaggtctggagatcaagaccatcctggctaacatggtgaaaccccgttttactaaaaatataaaaaattagcccggcgtggtggcatgcacctgtagttccagctactcgggaggctgagtttggagaatcacttgaacccgggaggcggaggttgcagtgagctaagatcatgtcactgcattccagcttgggcaacagagactccatctca

SEQ ID NO: 39677 - DNA, 494 bp, Homo sapiens
gacgtgtttagatacacaaatacttagcattgtgttacagttgcctgtggtattcagtatagtaatattgctatataggtttgtagcccagaatttcataaaagaaagaagctttacatgaatgagaaaagcataatctgacaataaagatcactttattagtggttctcagccttggctgcacattgaaatcacctgggtaggttagatttttaaaaaatactacccaaaatcagactctggagatatagcctgggcatctgtgcattttagaaggtcttcagatgactttaatatgtggtcagagttgagaacttctgtgtagctgtgtagcttagcaaaaaacgacagatgtaatcctgcttatggcttgaccacagactttattttgtagttattaaaagttaaaggccgggcgcggtggctcactcctgtaatcccaaagtgctgggattacaggcatgagctactgcacctggcctgagggttattta

SEQ ID NO: 39678 - DNA, 305 bp, Homo sapiens
taaaagaaatgatggagttagaaaatcactgaagtagtttcgttgtctggggaaatacctgtggttcgtcatctcatgtcacacagattaaggacatggactcacacacatggagcgggttaaggagcagaaagtttaataggcaagaaagaagagaacaaatcccttgtacagagctgtgtgtgtgtgtgagagagagagagagagagagagagagcgagcgtgagagcacaagcaaaaaaattattttaaggaattgactcatgcaatattggggatgccacatctgagatctgcagggcagg

SEQ ID NO: 39679 - DNA, 588 bp, Homo sapiens
tgtcttccaaatttgaaatgagtgacagtgggttataattaggggagaagatgctcttgatgctactgagaagatacagagtgagaacttttcttagaaaagtctgaggttgtaaagaagaaccaagcagccaacagagcagtcagcagagcagccacgatgatgattctagcaggttcctgagtcctcgagcgcgggaagaaagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacacccggagcagggcgtgcagcgcagcttctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattgg

SEQ ID NO: 39680 - DNA, 450 bp, Homo sapiens
gcagtggcatgatctaggttcaccacagcctccgcctcccaggctgaaatgattctcccacctccatcccccaagtaggtgggaccacaggtgcatgccaccgtgcctggctaatttttgtactgtttgtagagacagggtttcgccatgttgcccaggctgatctcaaactcctgagctcaagtgatcggcccacctcagcctcccaaattgctgagattacaggcataagccactgcactcagcccaggccttttaactactaatgtatattactcttgttatggcatgcattcactcactaagcattaggtaactgcctaccatggaccagacactgtggcaaacatttataaattttacaagtgtaaataagaagagattcctgttctcatggaactcaaaatctaagagtggaggcaggcatttaaactaagaattacaacagag

SEQ ID NO: 39681 - DNA, 459 bp, Homo sapiens
acaagctcctacctgaacactaagcctgtgtgtgtgtgcgtgtgtgtatgtatgtgtgtgtgtttgcttgcgcccatgcgtgcatatcgtgggggggaacctgaaaagatatatagtatttgcgagaagtgtaacactgggctgcaaattcacacatttgcacatttctcttattattaacaatgatacttagacctttgatttactaatggatgagaattgttggaacaaagacttggtgctgatttcctgatggattaactttatcagtctgcctctctcaagcctcacatctatattactcaggaaccctcatgtacagatacacccctcctggtccctgagttattctagaatagagtggaaagcagattaaaccctcaactcttccacatggagtttgaaattagcctcgccatttggaatttggctcaacatcatagagctggtgtaggacag

SEQ ID NO: 39682 - DNA, 415 bp, Homo sapiens
gtgtttacttatcgatcacaatgcacttacctaacatatttattgggttttcacactctgccaggcactgagttaacgttgctagatgaaaagaccggcagaactatttgcctgctaatttgtttccgttttcttcaaaggaaaatacttccttaagggatgctcacagctctcttgagctttgagcatgtcaggaggatagttaacgcagttcagaagaacccaagtgtccaagcattggcctgttgcgcactagggatagctggagtgtgctggtgtgtgatggccaaaacactggtagggatttctgagtcatcacggaaaatgtaaagaatgtcagagacctgaaatgggaaaatattctacttgttttcaagcatcaatgccctataatctgcgtttacgaatttaaata

SEQ ID NO: 39683 - DNA, 502 bp, Homo sapiens
aaccaacctgtcagttacaaaactcgcagtgttcatgagacataagacagttgttcaaaaaatacatttatccctttgatagtgaatttttagacagaatttcttccggaagttttcataaggaggacaacatgtggtataaccatgatgcctttcctaggactgttttttatttatttgtttattttatttatgtaacttattatttcctctggggttaagaagcaccactgagttttgtaattagacaagaatacatagcgaaggacatgggaattaaatggcaactgtatttttgttttaatactgagcccaaactccttggagttacagtgttcgtcgctccaggtaatcctctactaacataattatttagatgttggttatccaaaaagaaacctgaactccacattaaggaccaatctgctaggagggcagcaagttgtgttaactgtgttaatgaagaagcagacagttttagatggaacttcgtatgataaat

SEQ ID NO: 39684 - DNA, 1589 bp, Homo sapiens
aaattactcctttccactgatatttattgagaaactgctatgctccaggtactgcgataaacactgggcaaatgttggagagctaaaaaggcatattcctcttataaagacattatttacttgtaacaaacaagtaaataaatgtattagtcaatatgtaagtaaacaaaaaaatggacaagcacaaattatattaagtactatgtaggaaaccaatagagtactgtaacagaataataaggtatatgggatgggggtgggaatctgttcagagatgatctacctgagaaggtaacatgtaggcagagatctgaatcgtgaggagtcagcctttcagagtaagtggagtaggcacttccaagagaaaagcatattcctggctatttgcctatcaatgtcatcttgaacaagggttagcaatctcctacctgtaccacagatgctatgtgccacctccatgctacctttgccaccaagagattcaatgtgatgcatgatttgaaggttcctcatcctgataccctgtggaaagtaaaatcagtgacaaataaaagcagatcattatctcaggtagagtctgctaaagatgatacttgcttgtcagtacatgagtatccaccctagtaaaaaaccacagaagaagtgggatttatcttcaatgttctctcacttccccttccaagtgcctctcctgccttctgatgctctttcccacaagttgcaggcaaataaagcatgtatattactctctttttatccagagttgctccttgtccttatatgaagtagattccagacctcacaattgtatatgcctacccttctactccaacccctcaaaaaaagaggaagaatgaaagaatgaacaagagaaaaggaaggaagagagggagagaggaaaggagggaaggatggtcctgaagatcacagttcggtgctgaaaaaagcatttctattaaacttcaagacagaatgaatgaccatagctaataatgtaccttaagcttttctagaatctttgtattaaaaaagttgattgttactaaatgtattttaatctcataaaattttaggaatttaaatgaagaatttcacaaagggtaagaaaaattatatattatatttataaatttgtcattatgattctcccattgtggaaaaaaaaacaaaatctcggtaccccaattcacaaagccaaaaggaagaaagtaagctgaacgctgagtcatgcaagaaactgctcgcttttgttcctaagctaatagctacagataaaaggtcagatatctccataggtaggtactctatgttcaccttatgtaaagtgccaatttattgagcgtaagaggattacctaattgactattccccagcctgctccttttctcttgcaacacatggagtcagcaatgggaccatatcctctctctttcccctccagcctgctttccccctttaaatactgaagccctcaaaatcatctttctaaaaaggtatgaaccatagattgttcctgtggatttgtgtttctttcttccgggcatatccttaagcttggcaaaataaaattctaaattgattgagtcctg

SEQ ID NO: 39685 - DNA, 804 bp, Homo sapiens
ttgagggccctgcagctggagacccatggggatctgatgttccagtttgagggtggtgctgctggcgacccaggcgggagctgatgttctagttttagggacctacagctggagacccggggaggagctgatgttccctttcgagggctgtgcaggtggagacctggggaggaactgatgttgttctaatttgagtgtggtgcagctggagatccagggatgagatggccctgcggttcaaatatgagggtcccggagctggactctacgtgaggaaccaatgctgcctctgatgtcttaggttgtggagctggaaactcgcggaggagctggtattggtgtttctagttgagggttgtggtatttccagggtttcacaaaggccagattttatttcagttactcagaagagaaagaaaatgtcttctgaaagaggtgaattcaatcattaccaatagaaaaagtatccactgtatttatctcttataccaacagaaaaatataacattttcccccttagaataatatatacatatatataaaacttaaggttctattgtatgtagccgaacaatacaatctggaaaccagcatgaaactctattattcacatgttaaaatgttgaaactatgaccaaaatatgaaaactgctagagctatcagaaagacacaagacaaaaagcttcttgcatatgtataaactaaatgtgataatctcaaaaaactgttcaaaattataattactttccagtttaaaaacttcaatcctaaatttaaaaaaaaatctatatacaaaccactga

SEQ ID NO: 39686 - DNA, 750 bp, Homo sapiens
ttgagggccctgcagctggagacccatggggatctgatgttccagtttgagggtggtgctgctggcgacccaggcgggagctgatgttctagttttagggacctacagctggagacccggggaggagctgatgttccctttcgagggctgtgcaggtggagacctggggaggaactgatgttgttctaatttgagtgtggtgcagctggagatccagggatgagatggccctgcggttcaaatatgagggtcccggagctggactctacgtgaggaaccaatgctgcctctgatgtcttaggttgtggagctggaaactcgcggaggagctggtattggtgtttctagttgagggttgtggtatttccagggtttcacaaaggccagattttatttcagttactcagaagagaaagaaaatgtcttctgaaagaggtgaattcaatcattaccaatacccccttagaataatatatacatatatataaaacttaaggttctattgtatgtagccgaacaatacaatctggaaaccagcatgaaactctattattcacatgttaaaatgttgaaactatgaccaaaatatgaaaactgctagagctatcagaaagacacaagacaaaaagcttcttgcatatgtataaactaaatgtgataatctcaaaaaactgttcaaaattataattactttccagtttaaaaacttcaatcctaaatttaaaaaaaaatctatatacaaaccactga

SEQ ID NO: 39687 - DNA, 773 bp, Homo sapiens
caattagaacaacatcagttcctccccaggtctccacctgcacagccctcgaaagggaacgtcagctcctccccgggtctccagctgtagggccctaagaagcccctgcctgaccacgtgagcattgtggacctggggaggaactgatgttgttctaatttgagtgtggtgcagctggagatccagggatgagatggccctgcggttcaaatatgagggtcccggagctggactctacgtgaggaaccaatgctgcctctgatgtcttaggttgtggagctggaaactcgcggaggagctggtattggtgtttctagttgagggttgtggtatttccagggtttcacaaaggccagattttatttcagttactcagaagagaaagaaaatgtcttctgaaagaggtgaattcaatcattaccaatagaaaaagtatccactgtatttatctcttataccaacagaaaaatataacattttcccccttagaataatatatacatatatataaaacttaaggttctattgtatgtagccgaacaatacaatctggaaaccagcatgaaactctattattcacatgttaaaatgttgaaactatgaccaaaatatgaaaactgctagagctatcagaaagacacaagacaaaaagcttcttgcatatgtataaactaaatgtgataatctcaaaaaactgttcaaaattataattactttccagtttaaaaacttcaatcctaaatttaaaaaaaaatctatatacaaaccactga

SEQ ID NO: 39688 - DNA, 707 bp, Homo sapiens
aaacccaaaccctgggcacagtgcctggaagtgtcagggtcacccactccccttaagttagccactatacatgttcatcttctgacaggcggggcaggacagacgccaggcacaggaatcagggcctggggtcctgcggttcaaatatgagggtcccggagctggactctacgtgaggaaccaatgctgcctctgatgtcttaggttgtggagctggaaactcgcggaggagctggtattggtgtttctagttgagggttgtggtatttccagggtttcacaaaggccagattttatttcagttactcagaagagaaagaaaatgtcttctgaaagaggtgaattcaatcattaccaatagaaaaagtatccactgtatttatctcttataccaacagaaaaatataacattttcccccttagaataatatatacatatatataaaacttaaggttctattgtatgtagccgaacaatacaatctggaaaccagcatgaaactctattattcacatgttaaaatgttgaaactatgaccaaaatatgaaaactgctagagctatcagaaagacacaagacaaaaagcttcttgcatatgtataaactaaatgtgataatctcaaaaaactgttcaaaattataattactttccagtttaaaaacttcaatcctaaatttaaaaaaaaatctatatacaaaccactga

SEQ ID NO: 39689 - DNA, 369 bp, Homo sapiens
tgcaggtggagacctggggaggaactgatgttgttctaatttgagtgtggtgcagctggagatccagggatgagatggccctgcggttcaaatatgagggtcccggagctggactctacgtgaggaaccaatgctgcctctgatgtcttaggttgtggagctggaaactcgcggaggagctggtattggtgtttctagttgagggttgtggtatttccagggtttcacaaaggccagattttatttcagttactcagaagagaaagaaaatgtcttctgaaagaggtgaattcaatcattaccaatagaaaaagtatccactgtatttatctcttataccaacagaaaaatataacattttccccctta

SEQ ID NO: 39690 - DNA, 363 bp, Homo sapiens
ggccggcgcctgtaatccccatctactcaggaggctgaggcatgaaaatagcttgaactctggaggcggaggttgcagtgagccgagatcgtgccactgtactccagcctgggcgacaagagcgagactccatctcaaaaaaataaaaataaaaataaaataaaatatccaaatgaaaactttcacacaagtagaaagtttattttttatgacatcttcgtatttatttcttacatatcatatgtgaaaagcagctcctttgctgaaaatctagtccatccaagaatgcatcatcatctctgaccaaaaacaatggctggtggtaaggccgtactgagaaaaaagaaaaaaatgttgaagctg

SEQ ID NO: 39691 - DNA, 2557 bp, Homo sapiens
  misc_feature (631)..(631): n is a, c, g, or t
agcggagtccccgaggtcacaaggcagtggcaggtgtctgtagtcctcgggttgactgcagctcgcggtggtccctctccgagcccaggaagccactccagtgccgagggagaggcctgggagcgctcggagtgtgcgcggactggagaagggggaggtggcggagtgattcgtagagtaaattcggtaccgaggggcggggtcggggatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagagatggatgccaattcaaaagacaagccccctgaaaccaaggagtctgcaatgaataatgctggaaatgcctctttcattttgggaactgggaagattgtgactcctcagaagcatgccgaattacctcctaatccttgcacaccagatanttttaaatcacctttgaacttttccacagtaaccgtagagcaattgggaattacacctgaaagctttgttaggaactctgcaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccagggcagccctgcactgtatcgaaatgttaacactttaagagaacgaatatcagccttccagtcagcttttcactccataaaggaaaacgagaaaatgaccggctgtctggaattctcagaggcaggaaaagagtccgagatgacagacttgaccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgagatatcatctaaacttggttcaacacagtctggatttttagttgaagagtctcttcccctttcagagctcacagagacttcaaatgcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattcc

SEQ ID NO: 39692 - DNA, 3690 bp, Homo sapiens
  misc_feature (631)..(631): n is a, c, g, or t
agcggagtccccgaggtcacaaggcagtggcaggtgtctgtagtcctcgggttgactgcagctcgcggtggtccctctccgagcccaggaagccactccagtgccgagggagaggcctgggagcgctcggagtgtgcgcggactggagaagggggaggtggcggagtgattcgtagagtaaattcggtaccgaggggcggggtcggggatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagagatggatgccaattcaaaagacaagccccctgaaaccaaggagtctgcaatgaataatgctggaaatgcctctttcattttgggaactgggaagattgtgactcctcagaagcatgccgaattacctcctaatccttgcacaccagatanttttaaatcacctttgaacttttccacagtaaccgtagagcaattgggaattacacctgaaagctttgttaggaactctgcaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccagggcagccctgcactgtatcgaaatgttaacactttaagagaacgaatatcagccttccagtcagcttttcactccataaaggaaaacgagaaaatgaccggctgtctggaattctcagaggcaggaaaagagtccgagatgacagacttgaccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgagatatcatctaaacttggttcaacacagtctggatttttagttgaagagtctcttcccctttcagagctcacagagacttcaaatgcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaaccta

SEQ ID NO: 39693 - DNA, 3733 bp, Homo sapiens
  misc_feature (631)..(631): n is a, c, g, or t
agcggagtccccgaggtcacaaggcagtggcaggtgtctgtagtcctcgggttgactgcagctcgcggtggtccctctccgagcccaggaagccactccagtgccgagggagaggcctgggagcgctcggagtgtgcgcggactggagaagggggaggtggcggagtgattcgtagagtaaattcggtaccgaggggcggggtcggggatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagagatggatgccaattcaaaagacaagccccctgaaaccaaggagtctgcaatgaataatgctggaaatgcctctttcattttgggaactgggaagattgtgactcctcagaagcatgccgaattacctcctaatccttgcacaccagatanttttaaatcacctttgaacttttccacagtaaccgtagagcaattgggaattacacctgaaagctttgttaggaactctgcaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccagggcagccctgcactgtatcgaaatgttaacactttaagagaacgaatatcagccttccagtcagcttttcactccataaaggaaaacgagaaaatgaccggctgtctggaattctcagaggcaggaaaagagtccgagatgacagacttgaccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgagatatcatctaaacttggttcaacacagtctggatttttagttgaagagtctcttcccctttcagagctcacagagacttcaaatgcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaacctacttttatgtagaaataaataagtttcttcatcattcagataga

SEQ ID NO: 39694 - DNA, 792 bp, Homo sapiens
tgaacttttccacagtaaccgtagagcaattgggaattacacctgaaagctttgttaggaactctgcaggtaagaaaagttgtcattctgttgtaatgcttttcaagtttaaaaataactttaatataactcagctttatttgtttatacgtactgtcatattttaggtacctaaattgcctactctgcaaacttgcttcttcagagagacttctttgcacatgcacagttcatttagcatagcagggatcacggaatcgcagggcacccagcatgataatgttcccaagtcagagtcgtgcttgatgccaatactagaaaataatgtgtgtgtgagtcactttttgacctgtcacctaggatacaggagggtgtatgatatgaatagtaataatgcattttgttttcatttatggcaaaaataagagaaagtttaagagcaattaagaaaatataatactgaaagagcaggatgtacctcctttaacaatcacaaacagggttgggctcagtggctcaagcccgtaatcccagcgctttgggaggccgaggcaggcagatcaccggaggtcaggagttcgagaccagcctgaccaacatagagaaacctcgtctctactaaaaatacaaaattagccgggcatggtggtgcatgcctgtaatcccagctactcaggagtttgaggcaggagaatcgcttgaacctgggaggcagaggttaccgtgagtcgaaatcgcaccattgcattccagcctgggcaacaagagtgaaactctgtctccaaaaaaaaa

SEQ ID NO: 39695 - DNA, 3625 bp, Homo sapiens
  misc_feature (631)..(631): n is a, c, g, or t
agcggagtccccgaggtcacaaggcagtggcaggtgtctgtagtcctcgggttgactgcagctcgcggtggtccctctccgagcccaggaagccactccagtgccgagggagaggcctgggagcgctcggagtgtgcgcggactggagaagggggaggtggcggagtgattcgtagagtaaattcggtaccgaggggcggggtcggggatttgaatcggtcggcgggcggaggaggcgggtggaggaggctgccgggcagagcgcaggccaggatcagcgcaggctgtgagtccaggtcagccgtcgggacctcgggctccgggttcgaagagcggctcccggctgcgggtgctttgccaggagagcccttccggacagaggagccggggtctggaaggagcggccgacgcgacgctcgcctgccacggggctctgggagtaagcctgtctgcctggcgggccttcaggtgcggcgtgagagatggatgccaattcaaaagacaagccccctgaaaccaaggagtctgcaatgaataatgctggaaatgcctctttcattttgggaactgggaagattgtgactcctcagaagcatgccgaattacctcctaatccttgcacaccagatanttttaaatcacctttgaacttttccacagtaaccgtagagcaattgggaattacacctgaaagctttgttaggaactctgcaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccagggcagccctgcactgtatcgaaatgttaacactttaagagaacgaatatcagccttccagtcagcttttcactccataaaggaaaacgagaaaatgaccggctgtctggaattctcagaggcaggaaaagagtccgagatgacagacttgaccagaaaggaaggtctcagcgcttgccagcagtctgggttccctgcagtgttgaaaagtaattggtctccagatattcaatattgatacagacagagcatgtgcagttgaaacttctgtagatctttctgagatatcatctaaacttggttcaacacagtctggatttttagttgaagagtctcttcccctttcagagctcacagagacttcaaatgcactaaaggttgctgactgtgtagtgggcaaaggatcaagtgatgccgtttcgcctgacacgttcacagcagaagtgagctcagacgcagtccctgatgtcaggtcaccagctactccagcctgcaggagggaccttcccacccccaagacctttgtacttcgttctgtactgaagaaaccctctgttaagatgtgtctagagagcttacaggaacactgtaacaacctctatgatgatgatgggactcatccgagcttaatctcaaatctcccaaactgttgcaaagagaaagaagcagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgaaaacatagaaccacttcaagtatcatttgccgttctcagttctcctaataaatcatcaatctctgagaccctttcaggcactgatacctttagttcttcaaataaccatgagaaaatatcctctcctaaagttggtagaataacaaggacttctaacagaagaaatcaattggtcagtgttgtagaagagagtgtttgcaacttattgaatacagaagttcagccttgtaaagaaaagaaaattaataggaggaagtctcaagaaacaaagtgtacaaagagagcacttcctaagaagagtcaggttttaaaaagttgcagaaagaagaaaggaaagggaaagaaaagtgttcagaaatctttatatggggaaagagacattgcttctaagaagcccctcctcagtcctattcccgagctgcctgaagtccctgagatgacaccttccattccgagcatccgaagactgggttcaggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaaccta

SEQ ID NO: 39696 - DNA, 1045 bp, Homo sapiens
aggagtctaactacagcagaaaattcctgcaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaaccta

SEQ ID NO: 39697 - DNA, 626 bp, Homo sapiens
ttggcgatcactaggtaaaaccacgggtgcaggtgtcatggcggccccaggtagaagctacatttgcataacaaaaaattagggtgggagggccagtctttagacgggctatgtaaatgattcacctggtcaaaccagtcccctgggccctatgtaaatcaccacctcctcaagcctctgtacaaaatcgattgcgtttcaccccaaacccggagaccctctcttgggtgatatttctcagcgtgaggaacctttccctattaaattttccgctcctaaacccactccttgtgtgtgtccatgtcctgaattctttcttggctcgagacaaccacgggtgtatcccccaggcaatggagccatttcattatgaggtaaatactataaaaatcatttttaaatttttttccaagagatgggattctcaactgtgttccccaggctggtcttgaactgggctcaagtgatcctcctgcttcagccttcagagtagctgggactacaagtgtgtggcaccattcccagatataaaaatcctaattttatgaaggataaaactggtgcttgaacacaggtactcaaaagcaggttctgtgctttccccttcactagagagcctgttaaac

SEQ ID NO: 39698 - DNA, 368 bp, Homo sapiens
gagatgttctggaattagatagtggtcatcactaactttgcttaacttttttaatatactaaatatcaccgaattgtatattttggtttttgtttgtttgtttttttgaggtggcgcctcaattggtcgcccagggtggagcgcagtggtgcaatctcggctcactgcaacctccacctcctgggttcaagtaaaatctcccacatcagtctcctgagtagctgagattacaggtatgtgccactgctgctggttaatttttttatttttagtagagacgaagtttcaccatgctggccaaactggtcttgaacacctgacctcaagtgatccaccagccttggcctcccaaagtgcgggattacagg

SEQ ID NO: 39699 - DNA, 319 bp, Homo sapiens
ccacgtcacaatactaatcagaaaatatagaagtctggatcaagttaaataagtaagggattaaacaaaacagaatagcacaccccctgcccctcctcccccttctttacctttactaagtcaacaagacagctagagatgccaagaattccagttcataacagttccaagtttgggctttcctgttatcttatcagagaggataggtagtttggtagcttggagtgataaaaataatgtaacccctataggcaaattttaaaaattcagctagaagttatggttttcttaacctgatcaacacagcaacatgaaatct

SEQ ID NO: 39700 - DNA, 373 bp, Homo sapiens
aaagaacacataattaaactacaccaaagcagagacaataaaaattagatccctaaggaaatcagcattagaatttctagatacaaatgtaaaataattagatataaaatgttcaaagatattttttaaaatggaattataatagcgagcaacaaaaggctatcaaaaataaccagaaagatttgaaaaacaatgttaaacaacagctataaaagagttaatgaaagatgaatctgaagaaataacagaatttcacacagaggagcaaggggatggaacatatgagagcttgagatgttgaagacactgagaaagtcaaacatgcccattgcaatcccagtaggaaagaatggaggaattgcaataatctgaa

SEQ ID NO: 39701 - DNA, 305 bp, Homo sapiens
tgaaacttcatagccattaaactctaactccccatttctccccgctctcagcccctggcaaccactattgtgctttcttaacattaagctccccccggctttttcttttaacatttattttaggttccggggtacatgtgcaagtttgttatataggtaaactcatgatatcacggggatttgttgtacagattattttgtcacccaggtactaagcctagtatccagtagttttgcccttctctgtcctcccaccctccaccctcaggtaggccccagtgtctgtcgttcccctctttgtgtcc

SEQ ID NO: 39702 - DNA, 232 bp, Homo sapiens
gtcactatgccaattcaaaacaaaacaaaacataactgattcccagctgtgcccagtccaagcccaaatctggagaaggcagccaccagagaccctcggaatcctcccgcctctggacacctgagccccatgccagaaaggaaaggaaagccaagcccagggttgggtgccttcctcagcgggctgtgtctgttgtccccgagactgctcctgcccacatctggccacggac

SEQ ID NO: 39703 - DNA, 317 bp, Homo sapiens
gtgactttaaaaactagggaaatgaatagaatcttatctgctgggaatcttgcttcaacaagatctcttagacttgctttggcctcattacaactctacaaaaaaaggaattttttttaaacctcaaataattgaggtaattaatttctttcttcaattcatggcacactctttacattattcttgcaaagcccctctgtgttactttttttgttttattcttcagttcatctccactttcccctatatacaaccacttaaaatatgcctttccagtcgactacttatgtatttatttagcaatatgtttctttata

SEQ ID NO: 39704 - DNA, 186 bp, Homo sapiens
cctagaaatgatgaaaccccaatagtaatgagcatatctagcatctaggacttgatatctcttagcagtcatcttagcaaagttgatgcaaaagtaattgcggattttgctattacctttaatgacaaaaaaaacgcaattacttttgcaccaacctaaaaaaggaaccctggctcctgggagaaa

SEQ ID NO: 39705 - DNA, 357 bp, Homo sapiens
gacccactggaggctgggatttgagatgagaggtcaccctcggagttggctccagctgctgcctctgcctgggacccctccttgggagttgggtggcagggccttgctgggggcacttcccttcgcatctggattttggcctcgggcccagggctatgggggtttccagagtggtgacagccttgtcctagcagggaccagcccaagcacttcctcccagagccctctgggagcgtcccagccccaaggctgtcattttgtcgtagggagtaaattgtggagtcagcagaggctgtcttccacactttctgtgccttccaggtatcctgtcattcctcattctgaaaacctaggctt

SEQ ID NO: 39706 - DNA, 298 bp, Homo sapiens
cagacccaggtcccccacccaccaccgagggcagcttttgccaccagaatcttgtcgttcagaggtcccggcacctccaggccgggtgtctgggcagaggtggtgtggaagtccccatgtacctgcttctgtccagcctcaaatgggagcgtcacaagcaccttccctgcacctcaggctccccgggcacgtggcggaccgaccctcgtccctgtgtgggccccgtcccctttactgggtctctaagcctcaagctccccaggcacctgggagaccaaccctcctccgtgtggggggt

SEQ ID NO: 39707 - DNA, 461 bp, Homo sapiens
aaccttgatgacagagaagtggaactcactgtgtacagtctttctaagataaaatgtgtttggattaaataatgtatataggatattgtttagttctgattgtttatagtaaaagcattgctgtcagtgaggcagtatagtgtagtgattgcaagctctggaagtatactgccaaggtgtgcatcattcctctgtactgtgtagaatggcaaaagcaaccttaagaggtagactgtatctttatgtagcaaattaaattatgatatactttgcgttatgtctaacacaaatgatcaataaaggctagctgctgttataatgaatttcctttcagagacattagttatgtgctcagtaatctttttgaaatgttcttttttattttttaagaatagttaaaaagtgtcctattccctgtccatccctggcccaccatggttttcttcaagattatctttaaa

SEQ ID NO: 39708 - DNA, 305 bp, Homo sapiens
ggattaatccattgatggatcaatgggttaatggattatcataggaggggaacgggtggctttatattaggaggaagagatacctgggctaacatgctccacttcctcatcatgtgatgtcctgtgctaccatgagactctacagagttcccagcagcaagaaggccctgagcagatatggccctctgaccttggacttctcagcctccgtgactagataaaacttgaattaaaagaagaggcaagaactggtgcttcattcatctctcccatcaactctctctttgtggtcctgatttgtcagt

SEQ ID NO: 39709 - DNA, 330 bp, Homo sapiens
ggattaatccattgatggatcaatgggttaatggattatcataggaggggaacgggtggctttatattaggaggaagagatacctgggctaacatgctccacttcctcatcatgtgatgtcctgtgctaccatgagactctacagagttcccagcagcaagaaggccctgagcagatatggccctctgaccttggacttctcagcctccgtgactaagccactgagacagtggtggggcagccaccttctcgttcttcttcttcttcctgctttccctcagagatggactcttaataagatatctcagaagctggactggcctaactggg

SEQ ID NO: 39710 - DNA, 394 bp, Homo sapiens
gaattccttatagacaagttctggaaaacagcctcagagccaaaagcaaggactttcaggaagaaagcaagtctcagagacagcctgcttcccaaggacaatcatgactcttctgggtcttaactaccagcaaaactaatggtggatttaatttctcagcccttgaggctgggagaatgcagaaaaaccagagggcagaggaacctgctggcagagacagctgaatccctgacagaaaaaatgagagcctggaagagatatgtgtgaagctcaaacacaaaagatttccttgaactagaaaatgtgatctcagaactaaaaatttccattgataaatcaaaggagaggacagtcattgctgaaaccccaaaataggtctagaaaattaaataga

SEQ ID NO: 39711 - DNA, 560 bp, Homo sapiens
ggggtttcatcatcttggccaggctggtcttgaactcctgacctcaggtgatctgcctgtctcagcttcccaaagttctgggattacaggcataagccaccgtgcccagtctatggcaggttttttggatttatgtttcttcaatatctttctacaaagatcagtttctaatagaagccaattaaacatagaaactctaaggtagcatatttcccaagtgttgggaggctttggagctttttagcttcgagttggtgtgcctgatagatgagaaacagcacaacagaaaagctgttcataggatccatgactctagctattgcattttttctcttgcattaatttttctagtgtatttgtaaaacctttttaaaaatatggattcttaattttaaaattaacctggtgcaatggcacatgcccgtagtcctagttacttgggaggctgaggtgggaagatgacttgagcccaggagttcaaggctgtagttcaccgtgatcacgccagtatactccagcctgggtgacagagtgagaccctgtctgtaagaataaaaaat

SEQ ID NO: 39712 - DNA, 284 bp, Homo sapiens
tggtttctacctcagttgtgatattaatctctccatttcattctaaatcctattaagagagtagaagcttaactttatcatattaatgccaagatctgggcaagcatttatctagatataaacaaggatatatgcctttcagaaggttatatcctcattgtgataatgaagaaaggggcttatatgttaactactgtgattccacaagacagagtgtttgggaagccccctttcacatttttctaacctgataagcaagaaaacataagaagaaattattttga

SEQ ID NO: 39713 - DNA, 367 bp, Homo sapiens
ggggatttgcatggtaagctatctgagttcagcccttggcatatcttttgtggggaaatctgatcaaagagattaaaaaggagcaggtaggctgctttccctagcccacctcaatcttggacattccaattcatgaattggaattggaattccaattcataccgagtgttcttccccactgagcttcccagctgagctccctgtcgtgggagacccaggaccggcacacggcccctgcctcaggaagctggcatgtgcctggaccccctgggtgcgagggccctgcttggtcctatcctgccggggactgagactgtcccatattctacttcagctgtcactggccgttcccacctattttaggagc

SEQ ID NO: 39714 - DNA, 397 bp, Homo sapiens
gtttcaccgtgttagccaggatggtctcgatctcctgaccttgtgatccacccgcctcagcctcccaaagtgctgggattacaggcgggagccaccgcacccagccactggactgtgccttttgattggaacatctctgtcagccccagggtctgcatcacacatggtctgcatctgtgcacatggctactgtctctttttagcagtgatatcaccctgcctcatactgttgtttatgaggccatctccccacctggctgggggccactgctttggccattcagagtggaattcctctgtcttccagcccctagcacaggcctgggccagcattgctgctcaggaaatgcctgtggaatcaaagtgaggactgtcccaggtgttgaggatttactgt

SEQ ID NO: 39715 - DNA, 712 bp, Homo sapiens
gttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttggg

SEQ ID NO: 39716 - DNA, 345 bp, Homo sapiens
  misc_feature (19)..(19): n is a, c, g, or t
  misc_feature (164)..(164): n is a, c, g, or t
  misc_feature (168)..(168): n is a, c, g, or t
gatccaccccgcctcgccntcccaaagtgctgggattacaggcgtgagccactgcgcccggcctttttttaaaattttttttctttctcccttctagtcaaagcatgaaacctttacgtcactggaaatatactgtagtgactttgaggggaataggatggtgnaagngtccgaattcggcacgaggcaaagaggtgtgggcaacccaaacatctactgttgggctaatagataaagaaaaagtggcctgtaatcccagcactttgggaggctgaggcaggcggatcacgaggtcaggagatcgagaccatcctggctaacatggtaaaacctcgtctctactaa

SEQ ID NO: 39717 - DNA, 1139 bp, Homo sapiens
gatccaagtgcattacagcacagaatcaggacccaaaataataaaacaggctgaactaatgggccaaatccaatgagataaagtttaagtaggataatataaagttctgtactttggtccaaaaaatccccactactcaagtatagggtacacaaaattttgttatatagatggcagcatatagatgtagctgttaaaataagtccattaaatgttaggcagcattataagcagtagctatctattgagtagtagaaagaacattggatttggcattagaaaactgggtcaaatcccagttctgacagtttggcccttaaactctttgatccttgctttcttctcagggtggttgtgaagttaaaatgagttaacatgtcttttgagttaacaagtctaatttccaagcacttgtgctcaataaatatgacctagaaaaattaccattcacaataatataagtggctgtgccactccattttgtcctagaaaagatggtacttggaatgagaggggccacactcaaaagcaaaccagagctacttctaaagttagtgactaggatggatgagcgactcaaaagagaacatgaagaatggctacaggaactggggataactgacttgaagaacagtagacttaaggagaccatatctaccttcaaacatctgatggtgtgcttcatggccttctgtagagctccaaaagatagaagaacactggagaacggaaaatagaagaatgtaggcaagggcgaccacttggtggggatgttgtgagcgatttcagcacaagtggatggttggactacatggcctttaacacgagagtctgactgtcatatttctaggacatttttcatgaaatggatccttctaagtctgtctcaaaataatcccaggatctctgctatcttgggttgggctggcttcttgccttaaaatatcatctttcttccagttctaggccagatctcttctttatccagtctgactttcttgcaccagtttactcttgctgactactttgttcaggaatttctggtcacttttaaaatgtcattccccccccccaaaaaaaaactatccaagggacacagtacaaggataatttgtggacatttttggggagatgagcca

SEQ ID NO: 39718 - DNA, 3196 bp, Homo sapiens
atttgacaagattcataaacgtggatggcatagcatcatcatttctcttaccaattaagaaaaattatggtggcacttaaaatattttactttgatttttcctttttggaacagtcagttttaaggtaaaatggcttgtaaatttgagtttttgctgctgcttgtaaggcaggtaaattatggcttgcatgttttcataagcataaataaatcttgtgctttatttgggatgaggaagttaaggcagttgaaaataaaataagtggtttggaagtttcttgagaagaggatcaaaagaaagagaaccaatatatagaaatttcacatgatcaaggaagtttatggatgcgtttgtggaaatcttactctatgaacttgttggattagatgctgttttattctctactaagtgaaaagtgctttatttcagtgctttcccatggttgggagagagtagctgttaactattctgggtaatgggggtgagtatgttgaggaagagatttagaaccagaagagtgaagagactcaaactgttccataacaaggaaagctttaaagaccttgtatttcacagtctggagaactagagggatctgactcttggtcagttcatgtaacaaattatttattgagtacttgctgggctctcaagattcatgctttgagcacaggcagtcattcagtttccagtccacctgattacatcagcatgcacttagttttctttcttgttcacaaggacttttgatcatgcaagacctggccaagtcttctataatccagatgggtttcctggggctgttacttgagtattcctgtcaaaatattttcgtgaaccctgcctctcttagcaaacactacttcataagtgttaacaaacatccttttaataatctattccagaatattctccaggagtaagtttactggttgggatttgtggaagccattttctcatgtttcccaaataagatatgtagtcttcagctgattcctcaaagatgattgacagggagtttcacccatctttgtggtagtttgtgagttcctaggcatgtaagtgattaaaagattgagtacctgctctcctaatatctacccacttttaccatgtcagtgttttatgaattagatcacttaccaagagaaagcagaaacgaaatacttgaatctgacaatatccgactggctcttttcattgctctggatttattttccacatcaatctctttggggtggccctagcctattattcctgtgggttcagctgaggcatggttagcctgggtttataattcagtttacgttaaacattccctgtgcagcaacagctgttcatttaggtactctttttttttttctccttattacagttacttttggtattatgtgctttatctttaaaagctttctagctctaggaaattgttttccctgtttgtgtctattttattgcatcttgtgtaacactgtggttatatctataccaacaactttttgttgctatggataccacagattgtcctgaattaaaaccctaacataataaatgtctgtttagccgttactttactgagtaataatactatattgtggcagtatggccctttaatactaaggaggtatggtgtagaaattatttgaacactcatatccaaatgttattaatgatgtttgacagttttctcaatgcttaatgatattcctcactcctcattccagggtagaggagggtttggtcccaggctatggacaaactgctaatttgtttgaagtttgaattatttttcatgggaaagggaagtgataggaaatgaccaagaccatccacttttgacttgagtatggatcgagtataagtaatagtttcctagcctcactgattgtaccatgaactgacagacctaccagtcaaattcatgtacccagataatggtctctcacatggcaacaaagtacacagcagtttgcagtatgtgtctcttttaaagccagttcagtgttttcaccttgacgaccactcctgcaaacagttctcatagagctcttctctgctccccaaatcaatatattttgaagctatgtcaaatatttacatagaaaggaaataaagttgtatgtgctttgaaaccagcaaaatcctttgtacaacacctctcttctccttctatgtttatgaatagagttcgtggaatattgccatagtgcaaataatgacttccgtgtatcacttataccctgtaggggtgagctttcaccttaggtgtggttatatcctagcagtgtatcaagcccactcaaataatggtctatatttaaaagtatgtgtctagtttacttatttatgtcatttaacatccataaatgtacatctctcagttgtatatcatgattgtaaatcagaaattttgatggcaaaaatattctaaaacaacattcttcaggggaaagaaaaacatggataccttatctagcattgctcataaaagtactcatgttcatcctttttggaaactattaatcatgctagccttagatcattttaagctcctttgctcaaaccaatcattgatgtgcagtatgaccagcagctagtaagtctgtggtgctaccagtatagcttggaagatggttctgaattaatacctcagaatgatatcaaaagtaaaagagtggttctattgctaaatatattgactagctttcttataacaattttactttgaaattcaaagttccaaagctaaatgtctaaaagaagtaactgcagcttgttctgctgattttggaaaatagtattaaccatgtaagatctttggggttggagtgaaggtcttatctgcattaattttgttaatgcacattgtagatgtggagaacatcttgacctgcataaggattgcgtctcattttattgtgtagtgctttttcgaaatatttacatttctttggttcccatgttcatgtattctggagaagtaaaatttcttgattactgggcagaccctaaaactactaagagaaacataacatgtagttagctgtctgctcatggtttgttcaaatctaagctaaccttaatggtgctgtgtccgctgtccacagaaaacgcccttaagtagccctaccttactccttagagcttattttgcttttgtatttaataaaagctgtcttaaatgttaaaaaaata

SEQ ID NO: 39719 - DNA, 359 bp, Homo sapiens
cggcctactataagaattctaccccaaagaggcaccttatattacctggtaagttacccattcaatccatttcttccttatgtttagaaacagggataggaacaagaaaacatacaccgtattttcatctatttattgttacaagtatgatgtgccaggtactagatgttatcccacaaataattttaaaaatctggaaaagtattatttctactttgaagtggagacagctagctaaaaatagcaaagctgcaatacaaacacaggctaagtgactcttatgtccatgcacttaactactgcttcagaaatgacaagacagaggccaccaataagccatagctttataacagtgggaa

SEQ ID NO: 39720 - DNA, 388 bp, Homo sapiens
ctgcccatcttggcctcccaaagtgctgggattacaggcgtgagccattgtgctcggccattcagttatttttctgtttccttagtagagcccaatgataatgaagaatagctgcagagatcaaagtatcctgaaatctattctgatttatgaaaagaaatttaaatggttttcaaaatagttttactattttctttgaaaacttgtgatccacaaattatctatatacatgcataaacctatatatgcacagacatcatatctcaggtaaacagaagacacatcttctaattttactggataaagtattcctcactgtagtatggtaaggttcacatttaccaattatgtattatttaaacaatcttactttaagatgaatgaattt

SEQ ID NO: 39721 - DNA, 557 bp, Homo sapiens
gccatatccagctttgacatggggtggctgagctgtggctgctagttcgaccccatccagagaagagaggctagcaatcaggtgctctggtcagcgtggttcctgtgggaagtgactctcccatgaacccaagcatattgttcctcagagaatattagactgttggagcagcaaataaccctaagatgagcttattcagcttcttcatttcacaggtgaggaaactgaactccaagaagttaaaaagacttgcttttttaaactccagggatgggctaatggcagagccaggacgactgaatccaacttcctgacctcttgtccactaatctttcctagacaccaggctaggccctgctaatctccttttgttactcaaataattaatttattaacctttgacctcctgataattgcagcatgaattttcgttcagttatccagtgtctacagatataatgaatgtcatatattactgaaatacttgattatggcattttaaaactggggtccaagttaacaccaaaagtggctacagtaatatgtctgttaagaaa

SEQ ID NO: 39722 - DNA, 339 bp, Homo sapiens
gaatttgagccaaccaaaatattaaacctgtcttacacacacacacacacacacacacacacacacaccggattgctgtccctggttcaagtgtgccaagtgtgcagacagaacatgagcgagtctggcttcgtgactaccgaccataaacccacttgacaggggaaacatgccttggaaggtttaattgcacaattccaaccttgagctgcgcgggttccaagagccaggcccgtacttgctgttgatgtcattggcttggggagttggggtttggtgcccagcgcggtcgttgggggaggggcaaggcatagaacagtggttcccagaccttgctgc

SEQ ID NO: 39723 - DNA, 358 bp, Homo sapiens
cccggccttccagaaatatttttcaaaggactagtaatctaatcgcgctatcgagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtt

SEQ ID NO: 39724 - DNA, 506 bp, Homo sapiens
cccggccttccagaaatatttttcaaaggactagtaatctaatcgcgctatcgagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtttctgaatgcctctaagcctatgttcagactctgttgcgtcaatgactggtagtatttctttcattaatatgtttgtcatctggtctgcaagatagggttggatgaatatacttaacactactgaactgtacacttaaagatcgttagg

SEQ ID NO: 39725 - DNA, 331 bp, Homo sapiens
atcgggagtgtctcatactttggtttactttagagataacataaacaagattaacacggtatttagaggcatgctatatccaagggagagaaacttgtcagataggctaaaatctagataattctacatattctgaggaattcatgctcctgtggctcttgcttataaatatcttggaatgtttctgaatgcctctaagcctatgttcagactctgttgcgtcaatgactggtagtatttctttcattaatatgtttgtcatctggtctgcaagatagggttggatgaatatacttaacactactgaactgtacacttaaagatcgttagg

SEQ ID NO: 39726 - DNA, 465 bp, Homo sapiens
ggttagaaggcccttctgcaggctggtagtgtctgttccacctggattaggttaactcaacaggtaattcctatctgtttatacacagatgctttagcgcttgctgtacaaagtcatttggctacacactgaggaggcccatgggagtagtagcctcctcaaataatgttccctacctatctgtcaataccttccatcttaggtattgagaatttaatgaggctgtgttttcttggctgtgcttcttgatgttggaagccatgttcctggggaacaaatctgtattcttttctcctaagatgtgagtttttttcaacctttgctaatattttaatggagcaaatgtacagatgttgagattttgcactgcttataaaatgcctaccatgttttttgcataatggattgtatagaaatgcagattatattcttacagcaaataaaaagatgcttttaacagaaaaa

SEQ ID NO: 39727 - DNA, 367 bp, Homo sapiens
ttttgctctctagtggctgtatgggaccgtggtaataatagttgctcttgtttatttcctgtttgatgtgttttgatgcaacagactattcagctcagacagagaccgtgtgctgcaggtgaggaacacaggctttggagtctgaattcaaatgcaacttctactgcttacagcgatagcaacccagggatgtttcttcgacttgcttccttcatttattcctcaaatgtttatcgagcatccgctgtatatcatgtgttatgttagaggctggggttacaatgggggcaaagatagacatggtcctggctctagtgactcttacagttcaattcaagagagatgtcaaataaacaaatgagtttgt

SEQ ID NO: 39728 - DNA, 314 bp, Homo sapiens
gcctagcaagttagtgctggttgttgtcaggagacttccacttagctgcttgagtgttctcatgtcatggcagctgatttcctccagagccattggtgtgaaagaataagccaaaaagccaatatgctttttatgaactagtctcggaagtcatatattctagtattgccatattctattctttggaagcaagtcactaaatataggaataagggtgattaggttctaccctttgaatggaagagtataaaagaatttatggacatattttaaaatcaccatgatggtaaaatgctatgttgtaatgcttagtt

SEQ ID NO: 39729 - DNA, 367 bp, Homo sapiens
actctctttgagagttactcatttttccctggatatctcccacatatagacaaggatacatagtcataagacaaaattacaacaaatttagtttaaagatcttaattagcttttatttgcaattccagaatcaggcaacatttcaatctatagaatagaatgggccaggcgcggtggctcacaaggtcaggagatcaagaccatcctggctaacacagtgaaaccccatctgtactaaaaatacaaaaaactagccaggtgtggtggcaggcacctgtagtcccagctactcgggaggctgaggcaggagaatgacatgagcccaggaagtggagcttgcaagtgagccgagattgtgtcactgcac

SEQ ID NO: 39730 - DNA, 318 bp, Homo sapiens
cattgaggagtttgaaagcaaagagtcttggattttagacatttgggaatggccaagattttgacttgttttgtgaaaagatgtatttgttcagttgagcaagtgtgaagcaaaatctttcagcatgtctattaatcttagcggtctgagtgatgtaagggtatgcgcactcatgttttatgatgtttggtttcataaaaatatgtttggtttcaaggcattggcctctattctctgttgactaagaacaaatttggagtaaggaaggcatcttgaattttatcccaaacctagtttgttttttaatcatcaactgga

SEQ ID NO: 39731 - DNA, 434 bp, Homo sapiens
acagactaatacagtaagttggtactagaggtggggtgctgctataaggatacctaaaagtgcagaagtgactttggaactagataacagacagcctgtgaaagcagccgaggcgggggggtttaccatgcaaagccacaggagctgagcttcccaagactgtgggagcccacctcttgcaacagcattacctggatgtaagacatggagtcaaaagagattattaagatgctttaagatttaattactgctccactggatttcagacttgcatgggcctgtagctcctgtttttggccaatttatcctatttagaatgggtgcatttacccattgcctataccctcattgtatctaggaagtaactaacttgcttttgattttacaggctcataggtggaagggacttgccttgtctcagatgagactttgga

SEQ ID NO: 39732 - DNA, 1377 bp, Homo sapiens
tttctggcaaaccttcttcttgagacattactacttttcataccacctctgtcctttttgaagaataaaagttttaacattccgtaggttaatgagaataggacttgggcagcagcaatcatccttcctgtcacctgtaacccacagcttatgctttcttcctggaggttcttgtctgccacaaaggctcactgctgataggaatttgtatatgatcaaaggtgtttagttttataaaacagttaagtccagtcttaattttccacattatcactttcaattttgtattgtggattacgcattttaaataaaaaattgtgtgattgctacattttggaaaacatttttttcaagaggcccatccgtaatttaattgtaaaagatactgacaaactaacttggtttattattttggttatgaccccgtcatttgacttgtctttagttgtcttaacggggactgaatatgcgtgcaaaggcacgattgatttatcatgctggcttttatgcaacttgtatatattttaacaattttcctgtttgctaaaggcttaggttaaaagttcattatgattgtttatacatttctggtgaatacatcatgatttaacaagtggaaagaacatctctttccttccattttctggcatactccccttggaatcagatctgaaacttttaagctaaaatttccattgcatttggagagtagttatttgtgtatgcatgcttttgagacattgtagcaataatactgtaatgttgagccgaatctttctcctcattgtgttcattcactgccaacatctggcttcatcttttggatgaatgttcattggttttgaaacagcctatagggtaaatactgtgtttgaggtacggatgattttcataactacttcctagaacatgtccatttgaagagcagtggggccttagaccccaaagtccatttatgtgtgggcaaataggaaatgttgcaaacaaaacaaagcactagatctaatgtccagtgaaatctggaatgaactagtcattagagccggttctttcatgccaggaaaaagttactcagccaaatctgaactactctcctgcagtttacacaggtggtatttaattgctgtctgtatggaggcaggctaggagcaaggctgtggacttgttgtgattgtcactagttaatcaagattccctttgtggtgcttaagaccctaaaaaggacactaggagctgggcatggtggctgacacctgtaatccaagaacttggggaggctgaagtggaggatcgcttagcccaggtgttcaagaccagtctaggcaggatggcgagatcccatctctaccaaaaaaaaaaaaaaaaaaaaaaaaaaaa

SEQ ID NO: 39733 - DNA, 542 bp, Homo sapiens
  misc_feature (77)..(77): n is a, c, g, or t
caacacctataaaaatatggcaagcgtcatgtttaatggggttcctctaggaggagaaaggtggatttttttttttngggcccaactcaaacattaaacaaaaacaggcatccagatgaatccaagatgatttcctttacaaccaagaaaatgaattttctttttgtctgaatagttgttacacagaccggggctccacagtacactgatgcagaattgcatcctaaaaacgggtcttctggtcacatacatttggaaaacaccttagtaccaaatcttcctcatgaatacttaaagatgtgagttataagtcctacggtaaaaacatgattcagctttgtagaatattaggttaaaaacatatttgactgcagatgccttctctgtcctgtgaagttacgaatgacactgaacactaacaagactacggatagggggtaactcaatcagagtcactatgaaacaacataaccctaaatcactcagcaaatgttcattaagaatgaactgctggggtcaggggaggcagtgaaagaaaaaaa

SEQ ID NO: 39734 - DNA, 428 bp, Homo sapiens
tctccccttccctgtcacccactaatctggtttctgtccctatcgttttaccttttctaaagtgtcatataagtggaatcatactatgtgtagacttgttttttgcttttttcacttagaataatgcttttcacacatgctcacttttacattgtatgtgaaacatcctttggatgggtatagcacgtgatccttgagagagcttatgagatcctacacacttctctgtgttgcaaaactctcagcagcactttggtgttcttaggaaaggttattgtggattgcttttagggttttagggctctgttggggtctctggaatacaagctttttattatcctagccttccatccctctaacttattatttggattggaagaatgattccaaagaccatctttgcttgcttgatcctgtataatatctta

SEQ ID NO: 39735 - DNA, 386 bp, Homo sapiens
gtcaaatacctgttttgataatgaaattggcttcctgtggcgttctcttggtacctcattaattacatttgctcagatgatatcagaggtaagccagcaagcatattctgaattccaatctagaggacatgctgcctccatgaggagccaatatgctttcattgttggcacatatgctccaaggggcagcaaatgctacatttggctttagccttcagctctcatctcaacacagtaacttgtcgattagatcactctcatcatgagttactccttactcataaacaaaatgttataagaagcctgacactggcaatataatagcaaagaccagaatactttacatttccaggttaaaaatggtgtattaaagatgccagtatagc

SEQ ID NO: 39736 - DNA, 311 bp, Homo sapiens
gcaggagctcacctgcacagcaccacacctctgcttccatccacatccaacctgtgtcctctctggcccctgagcgagcagaggatggaccttgccattcccaggggcagaggctccgtcatccctgggacagaaaattaccaaacgctagagtgtttatttcacccactggttacgatctggccacaaggagctcattcaccctgacctgcctgtcttcctggccttctccagacatttctttgttctcgttccaccaaatgctggagaccagctcctggagcattatccttctccacgtggccatttta

SEQ ID NO: 39737 - DNA, 452 bp, Homo sapiens
gcaatggttgtacaacagtgtggaggtacttaatgccactgaactgtacacttaaaaatggttacaatggtcaattttatgatgtgtatcttttaccacagttgtgttagtttgctagggctgccataataaagtaccacagactggcaggcttaaacaataggaattcatgttctcacagtcctggtggctgcaagtctgagatcaatgttatcagcagggttggtttcttccaaggccttgatccttgccttgcggcataaacagcaattacttttgcaccaacccaattgatggctgtcttccctgtgtctttatgtagtcttcctgctgtaccagtctgtgccctaatttcttcttcttaaagcaaaaccaggctgggtgtggtggctcacgtctgtaatcccagcactttgggaggccaaggctggcagatcacttgagttcaggag

SEQ ID NO: 39738 - DNA, 2741 bp, Homo sapiens
gaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttgacaagag

SEQ ID NO: 39739 - DNA, 271 bp, Homo sapiens
gaagtgatactctcctgtttctgatgattcaacatgcaactgtggacaattaatttcctttagctttgctttcatttcttcatgtgtaaaatcaggctaacataagctgttttgtggattttgtgaataattctattataaaacatttgtaggttgtgatgcttattgaattagatattagtaataagcctttaataagtaatttcaagaaacatcccttgctaccgtctacttccccagaccaagaaaaatcttaatttattttagttgt

SEQ ID NO: 39740 - DNA, 408 bp, Homo sapiens
tggtgctccaggtaaggctaatattttagttttcattatcctttcattttttccacaggcagaaggcatatatgtaaacttttggcaaaacactagtttttctttatagcatggaatccagttttattgctggggtgaaaggatggggattatgaggtaaatgccttgagctcagttggcctctctcaaactgcaaattcgaaacccttccaaagcacataataatttccatgcaatttactatgtaaaagtctttggcaaaaggccctattaggaacataagactccagcttgctagaacactattccatgacatctttattctagattcatttgtcctggagttatttgtcaaattcttgttgaaaatctgataactctgattatttacattggatagttgagatt

SEQ ID NO: 39741 - DNA, 439 bp, Homo sapiens
cagtctcctgagaaaatagatttttcttttctgttgcatcatcaggctacaaattttctgaaattgtatgctctgcttcttctcgaatgctttgctgcttagaaatttcttgtgtcagataccttaaatcatctctctcaagttcaaagttccacagatctgtagggaactctagaaaaaaattcttattttccctctttcccgcctatctgatgcccgtttctaatacaggtgcacaatgcctgcagtgtctttgcatagtaagagtgactttactccatttcccaacaaattcctcatctccctctgagaccacctccgcctggaccttgttgtccatatcactattaacattttggtcaaagccattcaacaagtctctaggaagttccaaactttcccacattttcctatcctcttctgagccttccaaactgtt

SEQ ID NO: 39742 - DNA, 561 bp, Homo sapiens
caatctagttaacatgtctgtttacttcctctttgactaggaaataacttctcatggataaactaacttcctgaggaagtccccaacttccctaggttgttagactaattaacaaatcagcagagagaagcactttagttgtaaacggtgtctttgcattctgtatatgtaaaaaagaaaaatgtagaaagtccacactgtggagggaataatatacaagtagtttaaaaattgtgtgtaaatcatttagagatggttgaagaattgtaacgggtgaagtctatgggaattaggtggcaacagagttaattattttatatatataacaaagaaactttctgttgtttatagcggctagtggttttcaagatggggtggggcatctggtacactgagggacatttattcttctaaatagtgagacatgtttggttatgtgaatattcagatgtgggctatagaaaaccagatttctctgcccagaagagagattctgagctgcaaaagaagaaggtgtaggaggatatccaggagggtgaagaaggagatggacccaaagaa

SEQ ID NO: 39743 - DNA, 400 bp, Homo sapiens
ggaccttatggaggtttgtactttcagttatgcatatttgactgcccagatgaggagattgtattcacatacatagctgctcttggcagagtcatggttaaaggtttgaacatactgtaccttgttggctattcccatagtcctaagggaggcattttgcttctccatagacagtaatcggcttgtcagagtggagtggctttttgtttttcctttatctagtagaatggagtgggctaagcctttctgggaagcaatttcttcctccaccgcatgaacagaaggtcatgggatactgtctctgaaacaaaggggaggtagtgatagaaaaatcagtgtctggggcataattggattgaagctctgtcaaggagacaccagttcctgcttggaagctgga

SEQ ID NO: 39744 - DNA, 453 bp, Homo sapiens
gcatatgcatgggcaattagagctacatcacctctgctgcctgtcttttaacattgattctaagctgcatactaatttcaaaaatctcaaaaccctaaaagaaatttaaaagcccctatatcttaggcttaaagaaataaactctttgtcctggctgagatgtcgttgtgaaaaagctttgtcctggttcctcagcattcgccctacacctgtctggcccaagcctcctcccctccagcctgggattactgtgatgactagtcccccaactctcagttacttgtacaaagtggacatcatgagacctggttctagtcttataaccttgagcagcttgcttaatctctctgagccagcagacgttttgttcagcacgaaaggaggatagaaatagatgtttccttttgacacataaaggcaaaatttctaggagttctcaggcatcctcaagat

SEQ ID NO: 39745 - DNA, 424 bp, Homo sapiens
gaaatacagccgaacacatacacacaaatcagattatgaggaattacaaaggtgggaggtgggattttaattattttgtgatagcgaatccagtaggaggtgggggtgcctccccatcccctttccctgctcctgttgtatgtctaggctcaggctttgtcatgtgattataaacatgttctttgatttcctctgcgtaaactggaatgttctggccaggccttcttctggaccacataaaagctttaggagatgtataaatagagttaaagtcacaggatcgtttccccacagtttgttctctaaattgagaaggctaaagtgagaggtgaaaggacacaggggatggggactcgcctctgtcctccctctccctgggcaaattcattgtcattgcctctgtcaccaggactttgaaccctgg

SEQ ID NO: 39746 - DNA, 975 bp, Homo sapiens
  misc_feature (10)..(10): n is a, c, g, or t
  misc_feature (203)..(203): n is a, c, g, or t
cttcggcacnagggtgatttgacctatagaattttccaaattcaaaatgtagaaaattaacctggcatgctggctgacgcttataatcctagcactttgggaggttgaagtgatcctacaacttcagcccctcaagtaactgggacagcaggtgtgtgccaccacatccagctaatttttttttgttgttgtattttttatanagacagggtttcgccatgttgccaaggctggtctcaactcctgagctcaaataatccgcctaccttgggcctgccaaagtgctgggatttcaggcatgagccactgctcctggatgcatgcaacttcttttttttttttgtttttttggagacagagtttcgcttttattgcccaggctggagtgcaatggctcgatctcggttcactgcaaccttcacctccttggttcaagtgattctcctgcctcagcctctcaagtagctgggattacaggcatgtgccaccacgcccagctaattttgtattttcagtagagactgggtttctccatgttggtcaggctggtctagaactcctgacctcaggggatctgcctgccttggcctcccaaagtgctgggattacaggtgtgagccactgcgcctggcctgcatgcaactcttaaaaacaaacaaaccagaggggaggggggtggggggagggatagcattaggagatatacctaatgctacgtgacaagttaatgggtgcagcacaccaacatggcgcaggtacacatatgtaacaaacctgcatgttgtgcacatgtaccctaaaacttaaagtaaaataacaataaaatgaaaaaaaaaagaaaaaaaagaaatatttatgaatgtaaatgtttattgtccatttttaactaataagcaagcttactaaaaactgcacttcacacttagcttaatgtttgagggaattaacttcataaataaaaactagaaaattaaa

SEQ ID NO: 39747 - DNA, 389 bp, Homo sapiens
tcatttcccgagaagccattcaacaccttatcttcatctaacctcgacccacagccccatgaggaagatcccattcccacccccattccgaagagggaactgggcttcagagagctatggagcttggatgagggggactgggatcagactgagcttggtccctcacaaaatcccttctccaaccactctttcatccacgagacaacgacctgtgcccagcggtgctactgagtgcccgttatttcccactggccacttctggaaattgagattaaagtgacttgatttctcagtcacactgttttgccatatttggtcatttttaccacaaggctgcactgtatttaaatcagaaaaataaaataaagaagcttcaaagataaagaaaa

SEQ ID NO: 39748 - DNA, 301 bp, Homo sapiens
tcatttcccgagaagccattcaacaccttatcttcatctaacctcgacccacagccccatgaggaagatcccattcccacccccattccgaagagggaactgggcttcagagagctatggagcttggatgagggggactgggatcagactgagcttggtccctcacaaaatcccttctccaaccactctttcatccacgagacaacgacctgtgcccagcggtgctactgagtgcccgttatttcccactggccacttctggaaattgagattaaagtgacttgatttctcagtcacactg

SEQ ID NO: 39749 - DNA, 1101 bp, Homo sapiens
ctgggtctctgcgccgcagccgcccgcccgcccgctcagcgcccggccccgggatgacggcggcccaggccgcgggtgaggaggcgccaccaggcgtgcggtccgtcaaggtggtcctggtgggcgacggcggctgcgggaagacgtcgctgctgatggtcttcgccgatggggccttccccgagagctacacccccacggtgtttgagcggtacatggtcaacctgcaagtgaaaggcaaacctgtgcacctccacatctgggacacagcagggcaagatgactatgaccgcctgcggcccctgttctaccctgacgccagcgtcctgctgctttgcttcgatgtcaccagcccgaacagctttgacaacatctttaaccggtggtacccagaagtgaatcatttctgcaagaaggtacccatcatcgtcgtgggctgcaagactgacctgcgcaaggacaaatcactggtgaacaagctccgaagaaacggattggagcctgtgacctaccacaggggccaggagatggcgaggtccgtgggcgcggtggcctacctcgagtgctcggctcggctccatgacaacgtccacgccgtcttccaggaggccgccgaggtggccctcagcagccgcggtcgcaacttctggcggcggattacccagggcttttgcgtggtgacctgagcggctcggggcgtcccagcgacgcgggaaggggcagggcgctgacctgctgctgagctggctgggctggacccggtccctaggctgtgaccgccgaactccactgcaacagacgggcgccaccaaagccaggccctgaggcctgggagtcctggactgagaaagggggttcctgggcccacctgctctgtgtagggctcgtcctgcggtgcccgagaatcactcgctaacccctatgcccggtcccggaccgacatcctggagccgcctgtgcagcctgatgccccctcgtggctgctcccagggctgcacctgccaggacctaatgttcttaggtccctctggccagaacccacacccggccccttcccacctgtcatactggtaactgtaacaagaaaaacgacatcactta

SEQ ID NO: 39750 - DNA, 1378 bp, Homo sapiens
ttagagtttaatcttggaaagactacaaaccactgtaataacctaagcattatttgattccccaaggaccaattttcacccctttgggggccatattaattttttatggctgctataccaaagtactatgaattttatggctgaaaacagcacgaacttattcccttgtagttctagaggccggaaatgcagttcactgggggtaatgtcaaggtgtagggccatacccccaggaaggctctggggaagcgtacatttcctcttccagcttccatctttttctggcttccagacttgcattctgtgtgttcactgactcatgtctgcttcctccatctttcaaagccagcagccgtgtagcatcttgtttcaatgtcacgttgcctttttcttctgtcaagtctccctctgcctgcctctcatgaggacagtgtgattacacttagggtctaccttgctaattccggataatctctgcatctcaaaatccttaatttaatcgtatctgcaaagcttgtgttaccatataaggtaagagtcacaggttcccaggattaggaactggatatctttggggaccaatactcagccacagaggtgataccactccccaccccttaaaaatgcatgttctacaccagtaaggaagaaagaaaataagaaagaagagtaaaagataataaatatgtaactttggctacaaatgaattctttattatatctcattctatttggggcacttgctattagaacaaagagagaagatatatttaaaattaataggattcagaagagtagagttgatgatgttcacctcattgcgatgtactcacccattcatttattttgcattacccttcctgcctggggccagtcagcagaggagggcagtgagtcactccaaggtcagacagtattattaccctcttattgtgatgggcaaatccaccattaagcttcagattgagagaaacaccattgagttggcaaatgctttcgatgtgtacgtgcagaaagtcatatgtatctacaattttccagacagcggcaaagagaaatggaaactctgtgctgtattttaattggctgcaaaatgtttccttcagaaattaccattccattaagcacctactctgtgcaaacgctttgcaaacactgctgggaatagctgcatgtataagggcatgcctacctttattagactgttcaggggaataaaatgaagttacaatttattctaatactagaatgcagttctctccccatggactgcacctttcaggatagtggcctgaatcagagcagaaaacacctgctggatatcctccaagtacacagtctgattagtgccctctgggaaacatggaggcagatacta

SEQ ID NO: 39751 - DNA, 474 bp, Homo sapiens
acctctccctgtggtgtttggaaggacagagtcccaggaccggggcaggaacagacctgggctgcagctaggagctcaatggagttcaatggaccggagcctggcaggtccacgcccaaaggcaaatggaaaatgtctcactggattaatacagcatctggtggtggcaggtgggagatatgtcctttcttttttatagttttctgtatcgatctggaattttgtataagcaagctttccatttacaattagacaaaataatcagattatactccaggggtcaagggggtagagatcccacccacacgtggccaaggtagggcccttcacccaccagcagctgcctttgtgggcgggtctctggtctcaccacaccagagcccctcggaacgctcttttcctgagatgacttccattctccagttctctcagctcagcctccctcttggcagtcacggctgccctccctcatcc

SEQ ID NO: 39752 - DNA, 526 bp, Homo sapiens
acaacataaaaagagttaaaatccatgatcctgaacatcagatatttgtgggttagaatccgaaactgatcacttattacatttgtgttattgtgtaaattactgaatttcttcatacctcagagtcttcatatgtaaaatgtagactataatatttatatcataaatttggagaatactgtagagaatttggcttcacagtttgttttccttcatttctctcccttcatatccaaataagcccagtatagcaatattcctttctatttatattaacttatataaatgtgcatgagaaaactgattggattcaataagatggtagaaaaagctatcaagcttctatattttgccaggcaactttctaatggctttatgtgtctaaacccactttaatactcagaaaaacactatgattacaatccttctattagcattctcatgttgtagatacagaaattgagggacaggcaggctaacttggctcaagacacacaagtaaaaatattcagagcagagattaaac

SEQ ID NO: 39753 - DNA, 389 bp, Homo sapiens
taagagatgggggtctcatcatgttgcccaggctggccttgaacgcctgggctcaagcaatcttctcacctcagcctccagctgggatacaggcgtgtgccactgcacctggctaacttatctatctttatatttaaagtgagtttcttatacacagtcactaggttgagttttcctttttttttttttttttttttttgagatggattcttgctctgtcacgcaggctggagtgcagtggtgcaatctccacttgctgcaacctccacctcccaagttctcctacctcagcctcctgagtagctgggtttataggcacacaccaccacacccagctaatttttgtatttttagtagagacagggtttcaccatgttggtcaggctggt

SEQ ID NO: 39754 - DNA, 742 bp, Homo sapiens
gggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 39755 - DNA, 608 bp, Homo sapiens
gatttctggctaatttgcttttaccgttaattcagaatgcttgtgatccacaggctatagtgagtgagttgtccctggcatcccttttccttacatacgtgttccactagaagcaagaaaaaccacatacagctgctcagtctgcaatacgccaacagcacacgcacacaggagtcctgtttagctcacttccatttcctacgtgcactgctgcacacttgacctacacacttgacatacgaaagtgtctctgatcatttaaacaactctacaagtgtgtattattacccccattttatacaggaggaaactgaggttccgtgtggttaggtaacttgcttgggtttccatagaggcagaggtagaatttgaacccagtactgtttagctcatgccctttctggaacactctcttgcctctctatcttttctttttgctgcactccagcctgggcaacagagcaagactctgtctcaaaaaaaaaaaaaaaaaagaaatataatctgcccaacccaacagtcaaatgttagccaccaatgtccttgtgttaccctgctttctgagggccagaagagattttcaaagattatgagcactaaaataacag

SEQ ID NO: 39756 - DNA, 293 bp, Homo sapiens
attttattctgaatcatcaagttcattattttctattatttcattgagacatttctgagaaattttattttacaaatttgagcggaaagttcctctcacaggggtcttcaggattgcaggaagctcagcatggcacccacgtgaaccaggcacctggatgtgtcctgctcttcagggcccttcgagggtcagagacctggcctagattctgagctttgcctttgctttcacacccaggctcagtaatattttcaatttcaaaaggaaatgagatcatggtctagagtctagga

SEQ ID NO: 39757 - DNA, 440 bp, Homo sapiens
actcatcattgcacttaatcctgcagcagtctgcagcagacttcacattccataggatcttctaaatgattccatctaccaaatcagatttaataaggctggcaaaatgtggtgctgtgtggggtcaatggggtgccactgtggccttttgtggtttctttctctttaagggtggccacagcctgataaggcatttatagcattgatgtccattctaggtccctgctcaagggacacaaagccatgacctggaaagttctggacattttgggaagagttttcaataagcttcattggagatttggcacccactttaatgagctccagaagacctttgagatgatcttagaattggccattatgtcagttgggagcatgtggtctcagtgagttctctttgaaaatttgctatttgactctagctttgattaaggacttta

SEQ ID NO: 39758 - DNA, 629 bp, Homo sapiens
tcctgcagtctaatagtataataagaacaagtctgtgtgttttctggctcaatcaaccttgagtgagtggaattaacttaagtaactacagaaatattgggagctgtttgtacaattttagttgacttctttatatcacaaggcctttgcaattttgtttgcagtttggatactaaaacaaaatgaaagctatttaagctgactctgttaccattcttgacaggctctgaactctaataagcctctatagtgtaggctattttaattgacattaactgtttacattcctatacatcctgcaaataatataaattctaattagggagcacttttgttttatttattgttgtatcttaagagcctagtatcatcctcaataggtgtaaataaaagaacaaatgtggttctcagatatatatggaactggcttgcagtcaaagaaaccaaagtcttcaaaattatatagttgtatatttcaataagatagtaagtaaaaggcacatagaataagatagttgtaatagaaaatttaagagattgttcagaaaaagacaagtcattctataaatagtgcatgcagtataaaaaggcaaggtaccatgaaatatgtgaatgggaaaatactttgg

SEQ ID NO: 39759 - DNA, 859 bp, Homo sapiens
  misc_feature (12)..(12): n is a, c, g, or t
  misc_feature (16)..(16): n is a, c, g, or t
ccactccagagnatcnccttaatccgtaccatcagtgtgcatttaaggtttctccatgtctttttgtaattggagaagctcattttttaaaaattttattcttttagattgttgaacagataaatacgaaactgccatcatcatttgcagaaaaactgtttataccatcatctaaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaataggggtgagtctttaattgtaatgactttgttttatccacagttaagccttttctcattacatatttatgtatttcactgtcatgtcaagatgtctgcagaatcactgtgtgtaacaaacagccatatttaagacatgcctggataaataaaattggtaggaatgttttcttggcattatatttaacttttcttcttctttttccttgacaaatcttgataagtttttttatattagttttattttctagaaaatgtcttatgaatttctcctatttgctctagcatgcttatagaaaatgtcagtggtttcttacagctcaaatttggtggtagttggtttaaaatgcggtctctttcttcttcccctggtacttttttctt

SEQ ID NO: 39760 - DNA, 1166 bp, Homo sapiens
  misc_feature (139)..(139): n is a, c, g, or t
agggctgacgttccagctggactgccgccatggaactcagcgccgaatacctgcgcgagaagctgcagcggtacctgtaggcggagcatgtggaggtggaggacacgaccctcaaccgtgctcctgtagcttccgagtnctggtggtgtcggccaagttcgaggggaaaccgctgcttcagagacacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgcagaaaaactgtttataccatcatctaaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaataggggtgagtctttaattgtaatgactttgttttatccacagttaagccttttctcattacatatttatgtatttcactgtcatgtcaagatgtctgcagaatcactgtgtgtaacaaacagccatatttaagacatgcctggataaataaaattggtaggaatgttttcttggcattatatttaacttttcttcttctttttccttgacaaatcttgataagtttttttatattagttttattttctagaaaatgtcttatgaatttctcctatttgctctagcatgcttatagaaaatgtcagtggtttcttacagctcaaatttggtggtagttggtttaaaatgcggtctctttcttcttcccctggtacttttttctt

SEQ ID NO: 39761 - DNA, 1264 bp, Homo sapiens
  misc_feature (139)..(139): n is a, c, g, or t
agggctgacgttccagctggactgccgccatggaactcagcgccgaatacctgcgcgagaagctgcagcggtacctgtaggcggagcatgtggaggtggaggacacgaccctcaaccgtgctcctgtagcttccgagtnctggtggtgtcggccaagttcgaggggaaaccgctgcttcagagacacaggctggagtgcaatggcacgatctcggctcaccacaacctccgcctcctgggttcaagcgattctcttgtctcagcctcccaagtagctgggattacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctgattgttgaacagataaatacgaaactgccatcatcatttgcagaaaaactgtttataccatcatctaaaactactattcttgcgttatcataaagaaaaagaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaataggggtgagtctttaattgtaatgactttgttttatccacagttaagccttttctcattacatatttatgtatttcactgtcatgtcaagatgtctgcagaatcactgtgtgtaacaaacagccatatttaagacatgcctggataaataaaattggtaggaatgttttcttggcattatatttaacttttcttcttctttttccttgacaaatcttgataagtttttttatattagttttattttctagaaaatgtcttatgaatttctcctatttgctctagcatgcttatagaaaatgtcagtggtttcttacagctcaaatttggtggtagttggtttaaaatgcggtctctttcttcttcccctggtacttttttctt

SEQ ID NO: 39762 - DNA, 366 bp, Homo sapiens
atataatcaattttcacaatatccaatgcatccaaaattaatttttctttatatttttatgggttaccttgagttcccatgtacttgttataatgtattgaagtttataattaatctttcgaatgtaaacttaggataattagaatgttgaagatatgatgactatattatagaaatactcattgggctatgcagttaatatgcttcagacgtggtatgtaaatgttgatggaaacaatatttcatgtcggttcagattcagtgttttattttttgaaacattgcagtggaatttttatgtttaattctgttagctggtaacagaacttctggggcaattttgtttcagtttgttgtaactcagaa

SEQ ID NO: 39763 - DNA, 475 bp, Homo sapiens
ggtgggggaggttttgaactgggcaccttagtgctttgtcttctggacctgctgttattctggagttttctccaaactagttcaccaaaaagtaacataagacatttgcatcatcttgctgctgtagctaaaagatgttctctcttacttttgaaagaaattctttctctttgttcagctcccctttcttccccctcctagttttgaactgagattatcacaaggatcagtgagatagaagaaataaataataaagacactaacactgaatgcttattatgtgccaggcactgttctaatcttcatagcaatcccatgaaataggctctcttgttggctacattttatagagcaggaaactgaagcctggagaagttagattagttgcccaaggtcacatagtaagtggtggggctgggattcacaaccaggcaattcagttcctgagcccagtcttcgccactgtgttttcctc

SEQ ID NO: 39764 - DNA, 278 bp, Homo sapiens
ccctgcttcctctcctgcctggggaaggatgtgcacacaccaggaagccaccaagaggggctcagatcccagcaggtttgcccttggcctgggccccagacccccctgtggtcctaggtctgaggacctgcctggggacagggctgggccgctggtcccagggccttgcagccccaaggggagggctgtgttgggcatccttgaaactggtgccccacccagcaccctgacgtactcccctgggggtcagctctccacagcagctgaggttggagggc

SEQ ID NO: 39765 - DNA, 279 bp, Homo sapiens
gaccaaagtcctctccttagtgcgcctacttcctgtgggcatcatgccacttggaacttattggaactggcccgggagactctgcagtctgcgccgtttgaaaaccctgagaaagagatgccacctcaacttgaatcatgacagcccatcgctcagtctcaccctaaactcatggagcttgtttcagctcctcacttcttgactgtatttgtactatgttgaaaaaatatcctgtccacaaagacataagcctaacaacctagaaaaacaacagggtac

SEQ ID NO: 39766 - DNA, 366 bp, Homo sapiens
tctcagcctgtgttttagaaaagtacctcttcattcctttgaattgaataaaacataaaagttattaggaaaaactgagactttctctaactttttcatgttgttgacattacacctgtcaacatagattacttcctgttagatttcctgttatacttccatgcatatataaaaatatatataaagtatagccattaaaataatgtttgtgagaaatttataacatagttgtgctcgttatctactgctatataacaaatgaccccaaagtgtagtagcctaaaacaatgcacatttattactgaacccaatttctgtgggctagaaacctgagagcaacttagctgggtggttcaggctcagggt

SEQ ID NO: 39767 - DNA, 439 bp, Homo sapiens
taaacacgcacacattctccaagcagtgcctgacagccttctttgcatcaaggagcacttacaaatgatccagagaccgaggagaatactgtctaggcacacctgctggagactcctccccgaaactctccaacatccctcttgccagatacaatcaacatgtgaagataatgaagaccaagaaaaaagcctcctagggcataggatacagctgatcctcctccctacattcagcgattggcctgctctgctctcgctcctccgacagcttcacctgctcctcttcatgttcctgtgcctgggtccagggctcatcctgttgtggtcgtggtgggcggcttcagccctttaggagcttcccttgggctctctcctcagggacagcttaaggagcaccagtgtgggagttcaccctttcagttcaaatgcagatcagtcc

SEQ ID NO: 39768 - DNA, 360 bp, Homo sapiens
gataagacaaataattggtgttatcatgccttctatccaagttttgtaagcaagaatttcatagcatgttttaacacaaatggcaaaaaaaataagcccacagcagcttgaagcattatatgtgaaatttactaaactagaaataagaagaagaagtgaaaacagtaccccaagaaagtcccagaagactgataacaccaaatgcaggggcccttgctctacctcaactccagcccaaatccaccatgaagactccctcagttgtcctgaaacacatgccctgaagcataatgtggtattataaaataaatttcctgaaaaatgacaagataagcttctaatgaactgtggctaaaatct

SEQ ID NO: 39769 - DNA, 575 bp, Homo sapiens
agaaaaactctaaatgtgacacaagggacacctgaaaaaactaaaaaagaatttgtctaaacttagttgcacctcttgttttatgctcagaaacatgggaatgctatctttataaatctgtaaaagtaattgattttaggggccgtcaaatggctggggagatcatgccaaggacagcgtgcactggtattagacaccactccaaatatgaaaataacacagatttgtgagaaaattagggaggaaaaatatttaacccaggtgattagaaaaagtgttgccagccaggcgtggtggctcacgcctgtaatctcagcactttgggagactgaggtgggcagatcatgacatcaggagttcaagaccagtctcggccaacatagtgaaagcccatctctactaaaaatacaaaaactagctgggtgtggtggcacgcatctgtaatcccagctactcaggaggctgaggtgggagaatcacttgaatccaagaggcagaggttgcaatgagccaaaattgtgctactgcactctggcctgggtgacagaccgagacacagtctcaaaaaaaaaaaa

SEQ ID NO: 39770 - DNA, 304 bp, Homo sapiens
gctggtctcaaaactcctgacctcaagtgatccacctgcctcagtctcccaaagtgctgggattacaggtgtgagctactgcagccagcctagaaagcttacagatcagaaaagctcaggtcagtcctgataaatattttaaaataaatacctcttaaatagataggacatctcattcctaactctatgttatcacagaaaatattgtgcccctcaggcaagaaaaagtttagtctgtggaaatcaaatttcaaagagacttatacagaatcatacatgtgctttttcctggttgttagaataa

SEQ ID NO: 39771 - DNA, 305 bp, Homo sapiens
tttctagatgagaaaacagacccaaaaaggccatgtgggtaccacatatgaaactcatttttggggaactaaaggctaataatatcaacaagatctagaagacatgataaattcctgctacaaatagctaaaagctattaagtagaagctggatattccaggcacattgctaatctttaaggatgatgtaagggagatttacttccgatttctttttgtgtgtgaaatacctcctttgagttatcatagtaaaataagactgtagggacaacattacagtacctggtatagactccctattgcct

SEQ ID NO: 39772 - DNA, 720 bp, Homo sapiens
ctcactcactgtcttaacccagcggtatatgctcccaactcccttgcagattgttctgttctatgcccctgcttggaactggcctctcttctgccttctattaggccatttctgactcagtccatagggattatggcacctataaattgcacacaagcatatgcaaaacatgcaaaaactcatatattgtgtctttgtaattgctgaaaagctgctaaagagcggagatcaactgcagtttcctttagtgtcgtgcatgttgttgagttttcccaggactccagatttgtgggcagtgattcattaagggaaatggctagcatttattgaatgcccgctatgcacaccaggtacaatagctaccattatatccatttcataggtccttggagaagtaatttgctccaggcccacagagtaagtgacagaaatcagactctgaagtcagtctctgatctgaaatccagattctttaaaccatttcagcactgtcccttagttttgcaaaatgtggcaatgcctagtgttaaactttaaggagcaaaaaccctcctggatgcattaattaatagactaatgatcaagagacgtaagttaatatacttgtttagagaaaaaccaaaacagtaaaatatggatgctttaatgttctaaatgtaactatcacccaacccaacaaaatttcacatgcttaataaaactctaaagagtcttgtgata

SEQ ID NO: 39773 - DNA, 773 bp, Homo sapiens
ctcactcactgtcttaacccagcggtatatgctcccaactcccttgcagattgttctgttctatgcccctgcttggaactggcctctcttctgccttctattaggccatttctgactcagtccatagggattatggcacctataaattgcactagcacttgctatctacataccttacttggcacctatttactacataattttcacaagcatatgcaaaacatgcaaaaactcatatattgtgtctttgtaattgctgaaaagctgctaaagagcggagatcaactgcagtttcctttagtgtcgtgcatgttgttgagttttcccaggactccagatttgtgggcagtgattcattaagggaaatggctagcatttattgaatgcccgctatgcacaccaggtacaatagctaccattatatccatttcataggtccttggagaagtaatttgctccaggcccacagagtaagtgacagaaatcagactctgaagtcagtctctgatctgaaatccagattctttaaaccatttcagcactgtcccttagttttgcaaaatgtggcaatgcctagtgttaaactttaaggagcaaaaaccctcctggatgcattaattaatagactaatgatcaagagacgtaagttaatatacttgtttagagaaaaaccaaaacagtaaaatatggatgctttaatgttctaaatgtaactatcacccaacccaacaaaatttcacatgcttaataaaactctaaagagtcttgtgata

SEQ ID NO: 39774 - DNA, 413 bp, Homo sapiens
aggaaggtggtctgattgagcaactttactctccacatggatgtctaacggctatttaatcttcctagagatgcttccagttttccaaattagtttagattacatgaatctctaattagtggaatttactgtaacaagataaaatggaaaaaaaggtgatgagagatattttggggcaagtactctcactgattctgactttttttcagattctccccctagggattaataatctaggattattctgggatttttataactttttggggtcttttaaagatccctccctgcttctttttttcccacaactaccgccataagcctgggttgagaaggggggctatctgaggtgagcacagccataggcgccagggcttacagagtggggcccttcattgactttcccgatttgc

SEQ ID NO: 39775 - DNA, 360 bp, Homo sapiens
aaaatgccaatattacatgcaatgtatgaaaaaccatgttgaaccattgtgcaggcgccaagaaatcccttgttaacacatgatgacaggcacatcatggcatctggacccctacaagacagatcgacttgctccctgtggggagcagcctacccttttcctttcacggtgctgacctcccttctgcacaaacggaaacaaacttttttttttttttctctttaatactgtgtctggtaatctcacttgatttctatcttaggagactacaacaagccaggatgatggtaacatctctgtcaagatgacatagatttatttttcctggctcctctctgctaaaaaccctggaataacata

SEQ ID NO: 39776 - DNA, 296 bp, Homo sapiens
cagggagcagtgctgtacttagttttaccttacttttgccagattctactaaaaattttacgtgagtttagccctgtttattcaactaaataagatacttgggaatttatatctaaaggaagaatctcagtcattgtaaataaatgacctaaagtcattattgtggaaatcaatcagagaaatccctttctggagttttacatcctttttggaactcttttggtatgacagctatatgactttaacacttcggaagtaattggatttggtgtttatatatcaacttcatagttaaa

SEQ ID NO: 39777 - DNA, 238 bp, Homo sapiens
ttaaacgagtctcagagatgcctttcccagtagaatcaggatgaatgagaaggtcttggtcacgatcaagaagactgtttactcatcctttgcacttctaagacatggtgagatagtacaggtgaaaaagacgtggcctggagttaataatgatggtagaagttaagttgaaggggggcagcactgtgcccattggcgactttccttctacgcaccagtgtagatatccatacacaaa

SEQ ID NO: 39778 - DNA, 370 bp, Homo sapiens
ctcgctgccatcaccaggaattttagttgaccattctttctgtttccttttggcccattgccctggaatcgcccaggggtactgctgccctggcccgtgccctcccaattcacaactaggactataactgaccagatttgatgccacaagctttcctcacccaacctgtgccactgcaggggaacaggacacctaaaacatcctcagcgggccagtttcaggacctttgtccagaaccaggtgacacttaatcccaaggacagatcctggaaagaatatcctggggtggacagggttgtgagtaaagcccactccgtcagaccaggatcactcccaccccaaaaccagagcagccaacctcggggagagc

SEQ ID NO: 39779 - DNA, 331 bp, Homo sapiens
tattcaccatagtgagaacagcgcaggaaagacccaaccccataattcaatcacctcccactgggttcctttcacaacacttgggaattcaagatgagatttgggtggggacacggccaaaccatatcatatggcaacattactacgtacctcactaatatgtacaattagtatgtgtcaatttaaaaatattttaacataaataaataagtacattaattaataaagacttccatggagttctcaggcctttgtcttctcacttgagctacatgccctccctctggctctccaacccctgcaatgaatgaccatcacagaatctcagttg

SEQ ID NO: 39780 - DNA, 290 bp, Homo sapiens
gcgtcgacacccgatgaggcaaccagccagaacgcctgaacgcaggcacatacttcctattctacaccctagaaagctcttccactctcaccacttcaacttctacctcaaggccaatgacccctgaatgaatacatctactgcaggccagctccctcgagcctcagatccctatggatgggatatctctacctggtgtcccatatgctcctcacgcctagagtgcccaaagctaaatatgaccccaaccccccgcctgcttttcttcctgtgttccttccaagtcgacg

SEQ ID NO: 39781 - DNA, 898 bp, Homo sapiens
cacgacgtggtgaacttttaaaaacggattcagtagtaccaaaatactcataatgtgcagacagacaaaagaactggaaggagtcgtgttttcagacacaggaagcttttcacgtgctccacctggacctcatctctcagcctcacactccgatcttcagcagcccccgctatgcgcccgagtcttgggacgtcatcccggagctcctagcctgcccgggaggcagagccatcagttgtctatcttttagattctcctcttggccccttatcccaactaaacacatcaccactgaggacctgtccaggggtttagctcctgatgaagagacagagaaaaggtcagagaaaggaagggtgacgctccatccaagatgactacagcgctatgatttccagatggggaaggtcacggatgctggacgcaacagaatctcaacagggacccgagagagagaggctcctctctccctacactaatatcccacgatccctgtgtcactttccagaacacactgtcagttccatggacctaggattataaaatcctgtaagatttatacagaaaatataaaaatctggggagggggaactgtgaaacaatgtgaaaaaaactatttgtcaaatggacagtggggaataacttctcctcccgcacctcctccaagcttctaacaacactcatggcacacaatacagaggagactgccataaaaatgacttaaaatgtgcccttttgaggtaaagtaactatgggacaagtgactataaaaatgacacagctggggagatccaaatctattcctgctcagcaagtttccagattaaaatgtgtctgcttacctaaatcgaaacatcttaaataataacatttttttaattggccttgttggccctca

SEQ ID NO: 39782 - DNA, 460 bp, Homo sapiens
agacaatttccaggtcataccgctgtgctgtcattgtgcttccagctgttgtccctgattctgtgcttgtggaggactgagagatgccagacacaggccagcttgaggactctagcatagaacctggctttgtttagtcctgtactattcttgcaccatcacagcccacccagggatggaaaaagacacacactagcaaccaaaatccaaatagaaggcaggatttacctgcaattcccaaactccccatccagttttaatgcttctatattgcatatatgcctgtattatgcaatccttattctgtttttaagttatattttctgatatcataagaaggaaaaatcataattttaagtagctgcctattataagtttccctcatcatgatataaaggctttgtcttggccttatttttgtagctaggaaaagatggaggatattcccattttatagatg

SEQ ID NO: 39783 - DNA, 1305 bp, Homo sapiens
cattatggggccctgcctacataagattgtattgttctcttaatcaccaaagcaaaatcttgtagctccattgtaagagaaaaggacagttcttagagctttgggcttagtaggtgatatgatttgaatatatggccccaccaaatctcatgttgaattgtaatccccagtgttggaggtggggcctggtgggaggtgtttggggcggtggggggggcagatccctcatgggtttgtgctacctttgcaatagagagtgagtttttctgagatctggtcatttaaaagtgtgtggtgcctccaccgctccatcttgctcctgctctggccatgtgacttgtttgctcccccttcaccttcctgaagcctccccagaagccaagcagataccagcaccatgcttcctataaagcctgcagaactgtgagccaattaaacctcttttctttatacattacctggtctcaagtatgtatagcaatgcaagaatggcctaatatcataggctatagaattttgcatatgtaatttcatctactatgtatattctgactcaaaaaccaagaatagaaaagcagttcaagtaaaaccacagctgcatttttgcctgcctctaggtatgtgagcttcaaagttggaagaaattaagcaacatgctttggaatctatggtgatctatagaaaggcaaagtttctggactcaccctgactgatggaaagacagactgcctgccaggacactaccctgctgtacccagtcttaagtataataaagatctcattttttactgtcaatgcaagccacattttcctattaggaaaatgtgaatgaaacaaagtgctcttcaagagcaaaccctgaattatactttgggttattctctgttcctcaaaaggattttgcatctaactgatagtctccaaattgtaatgacagtatatagatagcttggtgtagacatacaggtcaatacaaatggagaaaaggcaatttgccattgaagaatatgtttgctttaagtaaagatcaatatactaagaaagctatacatatctagacttccaaaaacagatgggaataaactactcagcaatcagaatattcgaagatggcactctgttcacttccagagaaaatagttcaaaactgtatctcaaagtggatataagctattgtactagaattagtccctgtgtgagcatttggcattataaaataagatgttcccaattaaaagatcactggtatgtagataataaaacgtgaaaataaaaatttaaaaataaaacaaaaattatgtgata

SEQ ID NO: 39784 - DNA, 1251 bp, Homo sapiens
cattatggggccctgcctacataagattgtattgttctcttaatcaccaaagcaaaatcttgtagctccattgtaagagaaaaggacagttcttagagctttgggcttagtaggtgatatgatttgaatatatggccccaccaaatctcatgttgaattgtaatccccagtgttggaggtggggcctggtgggaggtgtttggggcggtggggggggcagatccctcatgggtttgtgctacctttgcaatagagagtgagtttttctgagatctggtcatttaaaagtgtgtggtgcctccaccgctccatcttgctcctgctctggccatgtgacttgtttgctcccccttcaccttcctgaagcctccccagaagccaagcagataccagcaccatgcttcctataaagcctgcagaactgtgagccaattaaacctcttttctttatacattacctggtctcaagtatgtatagcaatgcaagaatggcctaatatcataggctatagaattttgcatatgtaatttcatctactatgtatattctgactcaaaaaccaagaatagaaaagcagttcaagtaaaaccacagctgcatttttgcctgcctctaggtatgtgagcttcaaagttggaagaaattaagcaacatgctttggaatctatggtgatctatagaaaggcaaagtttctggactcaccctgactgatggaaagacagactgcctgccaggacactaccctgctgtacccagtcttaagtataataaagatctcattttttactgtcaatgcaagccacattttcctattaggaaaatgtgaatgaaacaaagtgctcttcaagagcaaaccctgaattatactttgggttattctctgttcctctagcttggtgtagacatacaggtcaatacaaatggagaaaaggcaatttgccattgaagaatatgtttgctttaagtaaagatcaatatactaagaaagctatacatatctagacttccaaaaacagatgggaataaactactcagcaatcagaatattcgaagatggcactctgttcacttccagagaaaatagttcaaaactgtatctcaaagtggatataagctattgtactagaattagtccctgtgtgagcatttggcattataaaataagatgttcccaattaaaagatcactggtatgtagataataaaacgtgaaaataaaaatttaaaaataaaacaaaaattatgtgata

SEQ ID NO: 39785 - DNA, 437 bp, Homo sapiens
atgtgcttgggaaaaactctgacatcttaagaaatgatgttactcatggctgacgcatggctggcatatgaatccatatgaatatgatatatgaatccatgtcacaggccctccctctttccataatagaacacttccaaaatggcttcccatctcttgttaagccatcgttagctccctgataatattaacccatgaataatggcctctagaatacattttttattatgatgaaaggtaaaatttcctttgctaaaaactataaaattttcctttgctaaaattataaaaaaaaacttgtaagcaaagatatctagatgctcctgatatcacaaaaatataaatagttactctaaaacttccccctcactgcacaggagggattaacaaatcacaggacattttccctattccctgaacaaagattatagacccag

SEQ ID NO: 39786 - DNA, 441 bp, Homo sapiens
ccttcttccactccccgcggcgcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacggtgagcgggccgggccgggctgggcccgccgctcccctggcagctgtttcccctc

SEQ ID NO: 39787 - DNA, 1213 bp, Homo sapiens
gctgcttctatagttatttaagaagcttgctaaaagttaaatgaattgcactttggtcctggagccagtttcattatgttacctgaggtcactcttatttgtaagagaagaataagattattttctacttactatcttgtatagatatatggtatatatggagtactattacaaccttgggagaaggatggtctataaatccttttagttatgaattttcattatatggtattacccaattacctataaagtatgttatgacacctggcatggtgcaaagcaggacttccagtgcgatgtgaggtggcaggctaaggaggaaacgatgtgtcgatgttgccttctgttcctttgatgggaattaaaagggaatcatgagaactctcattctgcagtgcctcttcctgtccagggtcctgctatgaggtgtcatcctcttgggcagaggaaaaaagcgccttttggataagggagaatttaattgtctaaatcaatagttactaactggccatctatggtttaggtgtagcctgccaacgtgttttattgggaccccacagttaaaaatatatagtactggtatttaaaaataaccatattttggcttcttttgaaaaattggaagatctggctaccccaggcccatcatcctagtggcaacatgtggcttggcgctgacggcccacctaaaggagcatgccctctccagagggtcgcagtcacttctctccagtgctttacacctggcccactgcacatggtcacctgaagttgggaaagtttcttgtcacggtcactctacagcttccttatagaactgtccatcttcagcttgaaaagttctcaaattattattggaattctacaacttgttttctgttgactgagaatttttcatttttagaggtgtttagaaatcaaaaagtgagactggtcattaagtattagatttttatatactggactcatgaacacaaacagcggtgcacaggaatatgttacccttggcatttatggattcattattctcgcagtttaatttagctcgatattatgtgttctgtgttatggggttttgtttgttttgttttgctggctgccagagctcatctctaataacttttctctggtttttaatatttactgagggagtagtctcatgtcacctttgcttcctcttgaaacttagagctgagcagctagtttgtatggt

SEQ ID NO: 39788 - DNA, 91 bp, Homo sapiens
aggatgcagcattcgagaccatctcagaagcacagagaccaggccccaacctgccagtgccaggatctgggacttcccagcctctaaaact

SEQ ID NO: 39789 - DNA, 447 bp, Homo sapiens
gctggtttaatcttccatatggaccactaaaactttcttcatattagcaacaagattgtttcatgttcactgacatagtgcttttaattttattcaagaatttttcatttacattcacaattggctgagtggtacaagaggtctagccttaggcctttctcactttttgatatgccttccccactaagattaatcatttgtagcttttcagttaaagtgagaggcacatgacttttcctttccctgaattgtttgaggccattgtaggattagggttaactaattggcctaatttcaatatggttgtgtgttggggaaacgggaggtctgaaaagagggagaaagagagatagggaatggctaattggtggagcagtcagaacacacattatatgttagccatcttatgtgggcgtggttcatggtgttccaaaacaattacaatag

SEQ ID NO: 39790 - DNA, 3345 bp, Homo sapiens
aggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacatattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgcgcggccgcgaattc

SEQ ID NO: 39791 - DNA, 1636 bp, Homo sapiens
  misc_feature (215)..(215): n is a, c, g, or t
  misc_feature (1239)..(1239): n is a, c, g, or t
caaacaaaaaaaaagcattctaaatccttcataaatattgtggttaatataatatattaaacatttagattttaaagcacaaatgcttgttaagtaaacatattcaattatatcatttctagaaatattccagatctaattctagaagagttctgtccaatagaactttctgtggtaatggaaatgttctgtatgtgtgctgttcaatatggtanccacatttgctgttgagcacttgaaatttgggtggtataatagaggaactgaatttttaatttaattttaattaacttaaatatccaagtgtggctagtggctacctaactgaattgcacagttctagaacataattgtcatggtgtgaacatagtctgctataacaacccactctccacaaataattacaaaattgtatttctttggtaagatttggtgtagccttcacagttcaatattgtgtcctttggctaaaagcaaggtacaatgcacatgccgaaagaccttagttttggatgtgatgaaatgttttctatgcctggaataaatgccttcctttgggttgtaatttcttaaatagtattgctcctctttctgtgagttatttaatttttttctctgtagtagctatgatttctggttttctagtgtgatcatctattgagtaagaaagactaatctcatttggttgtttttgtttttgtttttaactgtccctattttaaaatatttagatgctaattcttccttttggcagtttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagtaaggatttatagatttttttttttcttttttactagaaagattcatattagaaaactttgggtaaagaaaaaaaaacttcatgtttgatattttttcatgagattggctttttaaatcaaagatgtaaataaatccagccactgtggtgcccgcctgtaatcccactactttgggatagcagatggagacaggaggattacttgagcctaggagtgcaagaacagcccaggcaacataatgatccccagctcacaaaaaaaattagctgggcatcatggcacacacctgtggtcccagctacccggggggctgaggtgggaggattggttgagcccaanaagttgaggctgcagtgaaccatgattgtgccactgtactgcagcctgggtgacagattgagaccctgccttaaaaaaaaaaaaaaaaaaaaaaatgtaaataagccaggtgaggtggctcccagcaccttgggaagccaaggtagaaggatcgcttgagcccaggagttcaagaccagcctgggcaacatagggagaccctgggagaccctgtctcagcaaaagttttaaaaaattagccgggcatgttggtgtgcacctttagtcccagctgctcaggaggctgaggtgggaggatcacttgaacccaggaatttgaagctgtagtgagccataatcatgtcactgcattccatcctggacaacagagtgagaccctgtctctctctctgtctct

SEQ ID NO: 39792 - DNA, 457 bp, Homo sapiens
gcttatttcaattgcctttagcaaaaccggttcccactcctaaaaagggctttattggaaaaggaaaagatatcaccaccaaacatgatgaagtagtatgtgggagaaagaacacagcaagaatggaaaatgtaagttacagaaagtatctatctctgaatttagagttttgtttgaatacctttcaaaaacaggattctaaatataataccttagatttctaaaaatgtctttctttctaaagatgtttttagataacaatatggcaatatcatggaaactgagacattaatgaaaatataaagtacctcagaataaatgttaatttcataataactatttattaattttagaatcaatgtgagtcaaaatagtttttcaacactgttatggaattttattctgaggtactttatattttcattaatgtctcagtttccatgatatttgccgtcga

SEQ ID NO: 39793 - DNA, 286 bp, Homo sapiens
cttaaagaagccaggcatgttggctcacacttgtaatctagaactttgggaggctcaagtgatcctcttgcctcagcatcccaaagtgctgggattactggtgtgagccaccacacccagccattgaatgttacagctttaacagtgaaagaagtaaagctcaatagtgaagaaatgaaagaagcctactatcaaactcttcatgtaagttgtgcttttaaaagaattcacacactacctttaaaaaatatttcctctaaactttaaaaaaatttccttaaagaag

SEQ ID NO: 39794 - DNA, 3437 bp, Homo sapiens
aggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtgaggagcacattttgttaacattcagatttaattactgtaagtaaaatttaaaatgtaaatacatcagttcatgttctgtattgaaataggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacatattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgcgcggccgcgaattc

SEQ ID NO: 39795 - DNA, 1448 bp, Homo sapiens
aggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggaggtaaatgagcaaaatatgataccatgatatgaaaacttagtctcttctccc

SEQ ID NO: 39796 - DNA, 3438 bp, Homo sapiens
aggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaaggtattataaccttattgtgacaacttcattgagtggtagaaaacactcataatgtgctcctaagtaaatcttcaactatttttgcttcttaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacatattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgcgcggccgcgaattc

SEQ ID NO: 39797 - DNA, 3297 bp, Homo sapiens
aggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacatattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgcgcggccgcgaattc

SEQ ID NO: 39798 - DNA, 2589 bp, Homo sapiens
ctaccatgttggtagaggggaaatttatagcactaaatgcccacaagagaaaacaggagagatctaaaatcaacaccttaacatcacaattaaaagaactagagaagcaagagcaaacaaattcaaaagctagcagaaggcaagaaataactaagatcagagcagaaatgaaggagatagagacacaaaaatcccttcaaaaattcaatgaatctcagaagctgatttttcgaaaagagcaacgaaatagacagactgctagcaagattaataaagaataaaagggagaaggatcaaatagacacaataaaaaatgataaaggggatatcaccaccaaacatgatgaagtagtatgtgggagaaagaacacagcaagaatggaaaatgtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacatattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgcgcggccgcgaattc

SEQ ID NO: 39799 - DNA, 386 bp, Homo sapiens
aaatatattaaagatgatttcaggtttaaagatcgcttcagtaaactaaatccacgtaagatcatccgcatgtgggcagaaaaagaaatgcacaatctcgcaaggtaaagaaaatattgtgctagacgtaatcttgggtaaatacctttttgcattaggataaaaaaatccatgctttcttttacattcatttatagaaataatgaaaggccaggtgtataacctcgattcatacttttaggatgaaaaagccattttcttttttctttcctcaatgaagcttgagggaaatctgggcattttctgccttagacactttatcatatatctaaatgccatttttaaattgcttttatcacgaagtaaaacttccagcatccaattag

SEQ ID NO: 39800 - DNA, 1092 bp, Homo sapiens
aggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagctaaaccggttcccactcctaaaaggctttcattggataaggacaccggaataagggagatcctgtagacgacccca

SEQ ID NO: 39801 - DNA, 500 bp, Homo sapiens
aaccacagggcacaaagacaggacgctgcatttgccggaaatggaatccaggtctcccgtgtgggaggcgagaattctgccactgtaccgccaatgcctcctgacccccgagctctgcagccttggaaacagttaagacacagacttggggaaaggagtcaagattttcaccatgttctctttggaagatgtgactaacaaaaaagacacccagagcaaaggctcacagtggagatttgcatcaggcaacaccacaaaattatggcttcacattaaaagggttgacttgaaaaagccttattctgagtaggctgtgtgcaactggataaaaaacctctgtaggaaaacatcagaaattcacccagctttttgtctctggtcttgtatccagtgtcagcctgtggaaagttcttgcctcgcttgttgatgtcttctctttgcctccccattgcctggtacctcccaaaccctttcctcccaaccttgacgcaaacatcagc

SEQ ID NO: 39802 - DNA, 356 bp, Homo sapiens
tgtcaataaaaatgtctgtgcatgttcaatacagacacaattcatttttgaatatttttgatcctcggttgaatctgcagatacagagagatgactacatacacacacacacacacacacacacacacacacacacatacacacacacatgtaattttaaagagtactgtgaatataaatctttaagggtttaaaaatttattttgaattaagttattggaattatcaacagtacccacttgatgaaaacaatataaataaaaagtgacgcgtgatgatctttcaaaatgaaaagaatttgatattgaaaatgcatctctccaacagctgaatggtgagcatcgtggaattttgct

SEQ ID NO: 39803 - DNA, 187 bp, Homo sapiens
  misc_feature (107)..(107): n is a, c, g, or t
  misc_feature (137)..(137): n is a, c, g, or t
gaagcaagatcatcggctaagagagaaaagaaggaaggaggtgttgaagtttggggagggaggaacgaacatgacaacagggagaatgagaagacgaatgcagtggnggagaatcttctgagcagcgcctcagtggnggagaatcttctgagcagcgccttccccagggcagctggaagcatttgag

SEQ ID NO: 39804 - DNA, 440 bp, Homo sapiens
ataaatctaaagcacttagaacagaatctgagcacataaaaagtgctctataagtattacccactgttatttttttcctggtgctatgaggcccgaatgtggttactttcgttaaccaccaagcgtagttcctagtatccaacaaatgttagtgcccatccctctgcagagcataagtagcattctgggggtagcgtttgacactgaaggatgtatttcgcaatcttataggcaatcttgagtttcaacagcttaaattttctttccttgctatttttccaatgtttaaagaataccttcttggccaggcactgtggctcatgcctgtaatcccagcacctgacaggctgaggcaggcagattgcctgagctcaggagttcacaaccagcctgggaaacacagtgagaccccgtctctactaaaatacaaaaaaattagc

SEQ ID NO: 39805 - DNA, 360 bp, Homo sapiens
ggcagccctatggttaaacctttgtctctgccacaacccgttgtctcggcgtattgacctgctgcatacattgggcaatggacctgtcatggttccacgaagattcaaggatgaacggagtaggcatgcttcctaagcccatggagctcacattctagtttggggagatagacaattaaaaatggtaacaagatcaacaagataattttagattacatcaagtgcagtaaaaacaaatgtatcatgtagtacaatgactaggagagggtatttttagatagggtgtccaggaagagtctttctcaggaggcaacatttgaactgggatctgaatgacaaggagccagccttgcaaaaaaa

SEQ ID NO: 39806 - DNA, 1093 bp, Homo sapiens
ggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctggtcctttatatatatgtgtgtgtacatatatacatatataaactgtatagtgtacatggtaatgatttattgctatgccccagatccttaatgtagttctcatcctccgcatgccctcagcacaagcgggtgactgactgttccctgatgatttggccacctcctgtgttggacctctagggaggaggggtttgggctactctccttatcctcgtgcccgaaatgctcagggtcccatgtgcctgttgttcgcctctctctgttcc

SEQ ID NO: 39807 - DNA, 710 bp, Homo sapiens
  misc_feature (702)..(702): n is a, c, g, or t
  misc_feature (704)..(710): n is a, c, g, or t
ctcttttgatactttgggatagaatttgtattaacagaagttttgaagtcattcagaatgccacatgaccaacgtggggtcaccaattggaacagggaagagatgtgcacaatggccctctctccagcttgtgtgagccggctccaacacacatcctgtggagcgagagtttggttgaaatttttaaaaaatgaaatagaaccacaaagaaaatatcagaacacattgcacttagtaaagaacaagggggagtctccctgcacaagctctctctctttgcctgctgtcacccacctaagatgtaacttgctcctccttgccttccaccatgattgtgaggcttccccagccacgtggaactaatgaggcagaagttacactgtgccagtttgggcccagctcttcacaggcctggcagcttccacttttgctctcttaaaatccagctttcctgctgaagaggctgcgtggggaagaatcctggaaaatgacaggacaccttgaacattcaagccctaggtgagcagtcagctgagtgcaacaaacatgaaggatcatagctgacaccacctagcgctgagaagaactggccctgctgagccctgaccaaattgtagaattatgagcaaacacatggtggctttaagccacaaagtttgagggtggtttcttttctaataataaacatttgctctactatanannnnnnn

SEQ ID NO: 39808 - DNA, 987 bp, Homo sapiens
gagccacagtggagcaggcgtggagtccgtggcaccatggcagggggtctctgtccagggcctgggtactcggtgacactgggagagaatgcagcctgcagcgtggcctcggaaactggaataagagagctgacctatgaaggaggcacgggaagctgggtgcagagatgaccgagaaactggcaaacattttggtaaaccagagcaccatgctgcgtgagtgaggagtaaccaaggtggaagtgttaaggatgaggtggaacgaatattcataccatacagtaactaacactgaacacagtcacctggaagagaagactggggagaatcgggacattaaggctcctgggcacttgcggtttttactccgggtcagcgctgtccaacagggatatagtttgaaccacgtctataattaaacgctttctggtagccatattaaaaaagaaacaggtgaaattggtttaataacatattttatttagggcaatatatgcaaaatactatcatttccacatataatcatttataaatattatttattgaaacattttgtattcctttttttataccaactctttcaaatccggtgcatattttacatttatagcatattccaatttggatactaaatttctgctgcaaatattttatctgtatttagagtttacaaaatttagagttaaaaaaagattttcaagttgttctaaacatgcgtttttagtaattggattgtgtatcaatttctaaattaagattaaataaaattgaacatttaagtgctcggttgatctaatttcaaatgtgattagtggccctactgtattggatagtgcagtggtaggcatttaaaagtaaagtattcatgttaaaaatgttaagaataacaagcaaagaatagaagtagaatatataacttctaaaccagtagagggggctgcatacaaaaaaaatcccgatcaattcaacagaaggggaagtgagaaa

SEQ ID NO: 39809 - DNA, 259 bp, Homo sapiens
ccagcagtacacgagagtgcctttttctctacctgcactaacactgtgaaagaaatatttatttatttatttattgagcacctattatatctattatgttcacagtactggggatcagagtaaacaaaataaaggtccccagaccaggcatggtgtcttatgtctgtaatcccagcactttgggactttgggaggctgaggcaggaggatcgcttgaggccaggagttccagaccagcctgggtaccatagcaagactc

SEQ ID NO: 39810 - DNA, 607 bp, Homo sapiens
gctggtctcgaactcttgacctcaagtgatccacttgccttggcttcccaaattgaggggattacaggcacaagccaccacaccatcccgctagctggttttgttgttgctgtttcagatccatggtctcacaatgtcctcaggagctgaatgtgacctataggtgggtggggattggcccacagatagatagttttaaaaatacaaatcttgaatttaatgccaacattggagaactggttaattacacataaaaagcaggatttccattttcacttgagttaaacaacacacctggacacactggtgatcgtgtccatcggtagcatcagctggagtggatgtgctgggcctcagcattggcagcgtgcctgggcctttgaaacagttgctcttagctctgcctcgttggccataggatttgaggttgtggcctaaccatgtcatttcagttttgttactagctaataaatcccttgaagtcagagattgtctaataattttcttcattctcccactgcctggcgtagtaccggacacatagtagttgctcagtaaattaatttgttcaaatacttccgttgtgtgcagctgagcatatactgag

SEQ ID NO: 39811 - DNA, 584 bp, Homo sapiens
ctaataatatttctgaatatggaagtaatgataccattccaactataaccagacattttattcccagtgggaaaatgtgtacatgagtttcaaatcggtgggggcagaaacacagctcccaccatgctcacacactgcctcacacagcaaatcgggacctgggcctggtagacaggatgagaagatttttgagcctgagatcctccttttctacactttcaacatgtcctgaattgatagaaaaatggggactattttgggctctgtatccactcgtttcgtcatttattttttctttttctttcttccccctcttccttcctttcttccttcctttcttccttcattctttcttcctttcaatcttctttttcaacaatattctccataccaacttaaagagatttatgtgcaagtagggaagggaattagggatgctttgttttagagatgcttgcaagccattactaagttaagagttcagattcatggcctgcctcttaattttcctaaataacccctagatcagagtgcctgatttcaagtctggtaatgaacataaggattatccaaaattcatgcaa

SEQ ID NO: 39812 - DNA, 611 bp, Homo sapiens
accctattcttcctccacgtaaagataaccaagtattcttatttttccagacaccatctgtgggaagggaaatttgccagtaatcaaaaaggcgtagtgtgttatctctcttaggaatatttttggcgtgagccaccacacccggccactatttttttttttttaaaggaagcaatacagccatgagatggctatcatttatgacttggcaccttataaaggtaaaggtggcctgttttacctttgttatgtggtctattggctgaacattaaccacatatttacgcatctttctgttggcatgtaggaatgattgcatttctgtagtgggaggagcctggtaaatgatttttttggcatatgcagattagacagaaagacaggtatgacttagtaaataagtgttccattcttcaagagtagagtagacagtaacattcctcaattattgagtggcaaaaaaaaaaaatcccctttttctaaaataccaagattgtactcaataaagaggaaatggaaatgcaagcaccataatcacatgcaaaactaatttatgattttggtttaaggagcttatattaggctgttcttgcattgctataaagaagtac

SEQ ID NO: 39813 - DNA, 346 bp, Homo sapiens
tagtaaatgcagatatgcagatttcaatgcttacatgaactattttattggatttggataatacctttaaaattgacattcattctttcaaaatatttggttttaaaactgatgcacaaatcaataaaatgatggttattacatgactgttaatgaaaataattttgccatacagaggaagggcatgtgcctgtagttccagcttctcaggaggctgaggcaggagggttgcttgagttcaggagttgtaggctacagtgagctacggctgggccagtgcactccagtgtgtgtaacagagaccctgtctcaatagatagattagatagatagataaatcgtggat

SEQ ID NO: 39814 - DNA, 714 bp, Homo sapiens
tgtttactccaacccagccccagagctgaaaatttcctgtggctgccagccgtctacttcaggaaagttcccatcaagggagccaggcctctcccattttggctgcaaccccagtgtccctggtttcttgagagacatttggcctcttgggataaccagggccttctcctatgctcttcatagtgtggaactctcccccatcacagataagcctattttgtgactccacctgggtgtacttgggagcaacaaaatcaaacctcctgtaagaatatttttgtctgccaagacccgcagaggctagctaggatggagagggagacagggaagcatagccacggccctagtgccctcctttccccagatcctccacctcaaccctgctcccacattccttctcctggaaatccatcctttcagcactactgacaggacaggtccctccagcctccaacttcagggaagtgtcctgacatagcagccctccctttgaagctaggcagtcttgcagtttgatcccgactctgctatctgtttgctgagtgttccctgctttaaatatcaggcatcttatttgtgaaatgtggctcaaatctacatctcaggattctgatgaagatgaaatgggataccaatgcctgacatgtagtagacatgcaatacatttgttaactcatgtattctcatgtatttacagagcaagacactgttctg

SEQ ID NO: 39815 - DNA, 149 bp, Homo sapiens
tcaccaacatggaccatatgctgggccataaaatacacattaaataatataaatcatacaatgtctgctctcaaaaaacaatagaattaagctaaaaatcaataattgaaatgtagctgaacatgtatagcattaaaagcatatattag

SEQ ID NO: 39816 - DNA, 390 bp, Homo sapiens
gcctcccagcttcaagcaattctcctgcctcagcctcccaagtagctgggattacaggcatgtgcaaccatgcccggccaattgttttgtatttttagtagagacggagtttcaccatgttgaccaggctggtcttgaactcctgacctcaagtgatctgatctgcccacttcagcctcccaaagtgctgggattacaggcatgagtcaccgtgcctggagacaaacatgactttttggtctgctgagctccagctctaccctgcttccaaagggtcatctagaatgactgagcagcatggtgtgacccctgttgtggccagaaggttagttttttctttttcttttttccttttttttttgagacagggtctcactctattgcccaggc

SEQ ID NO: 39817 - DNA, 375 bp, Homo sapiens
gtctttagaggtgaccatagtgtcacatcctagttcttgcttggggaatttaattttggaaacagggaagagtccgtgggagtaaaatgtggtgaatgacaggaatattcaaccaggggcagtgcgtggatgtgaaagcaaggcaatccaaataagtttctctaaatataatcttggaaatgtgctcctcagcaacaacaggtttattttaaaactttaataactgctaacacgaggagccatgggagagagattaaagcaaacagttgttgaatgaatgtataaaaaacatgtgtgcctgagtgagaggggcttctggctgggtagaaatgtggaaagtaaaccagatctgaaagacatttctgtgaaggactt

SEQ ID NO: 39818 - DNA, 429 bp, Homo sapiens
ataagaaaaaaacctattgtcattttttcttatttaatttttttgtttgtttgagacagagtcttgctctgttgcccaggctggagtgcagtggcgtgatcttggctcattgtaacctctgcctcctgggtttaagccattctcatgcttcaggagcccgagtagccaggattacaggtgcatgccaccatgcacagctaatttttgtatttttagtagagacagggtttcaccattttggccaggctggtcttgagctcctgaccaagtgatccgcccaccccgggctcccaaagtgttgggattataggcgtgagccatcctgcccttctgttttatttaattttgtattgtgacaatagcttcttcaaatacaaaaggaggaattttgtaatcctgttgtttaaaaagtttgttccactagttact

SEQ ID NO: 39819 - DNA, 309 bp, Homo sapiens
aaatacgtcttccccagactcattacaggatcaaatgctgtcagtcttgtgagctttttgcttcttatgtatttataaagactgatgatacccctgatttcagtcatgataaatgaataaattgtttaatattcattaagaagtaatttacacagagtttaactttttcatcttgtcctaatgcagaattcctatgaatttctacttttatacttcatcagataattttcataataatgggttattgaactttaaaacaagattgtgttttctcttatggatattccttgctttcattaaatgtcatct

SEQ ID NO: 39820 - DNA, 325 bp, Homo sapiens
gggagccaggattgcaccactgcactccagcctgggtgacagagcgagactccatctcaaaaaaaaaaaaaaaaaaaaaagatggcatgaggttcctttcccttggtttctcctacctcctccttcgcttcccatgcctgtgtgttaggtgtgatgggaaaatacctttgccccacagtagacagaggtcatggcttagaaaaagggaattcatggccaggcacagtggctcatgcctataatcccagcactttgggaggccaaggtgggcagatcaggaggtcaggagatcgagaccatcccggccaacatggtgaaaccccgt

SEQ ID NO: 39821 - DNA, 131 bp, Homo sapiens
tcacaaagatgccatcagcctcaagtgggaaaatgcacattataagcccttcgtagtttgaagcaccttttattcagcaatgccactaacatgggttctggggacaccatggtgagtaacttaacaagcac

SEQ ID NO: 39822 - DNA, 1381 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggagg

SEQ ID NO: 39823 - DNA, 455 bp, Homo sapiens
aggagaacttaggccttagtacgaggcctggttcgaatcggccgagggcgcaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactg

SEQ ID NO: 39824 - DNA, 1521 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaaaaaaaaacaaaaaaaaaaagggggggaggcaccgcacgggcaaacgggggggagcccaacacatacacgggaacacagggcgcgccatcaaacccctgtgtgtaacgcccaaaagtgagaagaagaaaacacaaaagacaccagggcaccagaagacgagaatgcaaaataaggataacggggaaacccagaggcttgacacaagggccgaaaaaaacaagagacagaacatgaaatgcccaaaactgcgccacgacaccaacaaaaagacaacgacagtgtacgccaagagaacggagaaaatcgggccacaccgacagcgaaacaaaagcgagcacctgtcacaacccaacggcggaagagcaagggtcacccaaaacagcgaaaaacagtgggaacaaaggccaacggtggcatcagagaacgaaccccacacccggatcgacagaacaacaacgagcgagagaccgaggcagaaatagatgggtccaaacgcgcacgcgccacacacacacacacaccagcgcgccgcaaaactacagggagcaaacgcaacacgagaagccagcggcaaaaaagcgcacgccagcagcagaaaaatgcagaccggagcgcagacaccaaccatctatgaaaggtagtgaatacaaaaatgcccgcacgaaaacaagaacacc

SEQ ID NO: 39825 - DNA, 627 bp, Homo sapiens
catggtggcattgagaggcggggccttttagcaagtaatgtcatgagggatcctacttcatgaataaattagtgccttatgaaagggctggagggagctagtttaggccctttttgctcttctgctttcctaccatgtaaggacacactattccttcccctccagaggatgcagcaacaaggcaccatcttggaagcagagagcagccctcaccagataccaatcctgctggcaccttcatcttggactcttcagcctccagaaccataataaatacatttctattgtttataaattatgagtttgatggccaggtgaggaggctcacgcctgtaatcccgccctttgggaggctgaggcgggcagatcatctgaggtcgggagttcgagaccagcctgacggagaaaccctgtctctactaaaaatgcaaaattagccgggcatggtggcacatgcctgtaatcccagctacttgggaggctgaggcaggagaatcacttgaacctgggaggcggaggttgtggtgagccaagatcacgccattggcactccagcctgggcaacaagagcgaaactccgtctcaaaaaaaaaaaatatgagtttgagtctatggcattttattata

SEQ ID NO: 39826 - DNA, 1749 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttc

SEQ ID NO: 39827 - DNA, 1898 bp, Homo sapiens
cggacgcgtgggtcgacccacgcgtcgcaaaggaaaaagtggttctggaaaagcggggaaaggtagagcggcagagcgatcaaggagaatgggggcgggtgaggagcgaagggagggaacagacagtccatctccggagtccgggacggacgcagcagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttc

SEQ ID NO: 39828 - DNA, 2160 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctattgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttc

SEQ ID NO: 39829 - DNA, 1400 bp, Homo sapiens
ctgtataaccctgaggggggtgggtggccagcttgtatacctgtccctgaactgagctgtttacaggactggggaggctccacccagaaggctttcatttgtactctgctgggagtgactgggaaaaactccttccctgctgctgagtggagagaggcctcatccggctttgacccacaatcgatcacaataccatagtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttc

SEQ ID NO: 39830 - DNA, 1305 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactg

SEQ ID NO: 39831 - DNA, 1437 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgctcaaaagaaaacaagaaaaaaaaaagaaaaacaaaacactggtgtgcgcgggcgcgccccgaggcccccggaaaaaagctttttagagaaccacttgcgcggtggggcgcgcgcggggggccccagttgcggtaaagggagacacagtgggccaacaaagcggtgttccccaagagggaaaaccccggggggccaaaggacaaagcggggcgggcggacttcctcccacaagtataaaaacacgcgccgggggggggacccccgggggcggttctgagagcacaaaaaatccccacaaatgggggatgctccagggaggggggccatatacagggggagagctcatatatacacagggggaggggtcccacaagcggagaaagcctcccagatattctcaaaaatttaagccccggcagcgaccgggggggggggcgcccacaccacagtcgttagcacagagcaccgaggtcactccacactgcgataacacgcgcgaccgacacaccacagcagagacgatgctaaacatcagtgagcagaaaacaccgacgaccactcatcgccgtaagcgtgaccgacaaacgaggacac

SEQ ID NO: 39832 - DNA, 1128 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggaggatgcagcaacaaggcaccatcttggaagcagagagcagccctcaccagataccaatcctgctggcaccttcatcttggactcttcagcctccagaaccataataaatacatttctattgtttataaattatgagtttgatggccaggtgaggaggctcacgcctgtaatcccgccctttgggaggctgaggcgggcagatcatctgaggtcgggagttcgagaccagcctgacggagaaaccctgtctctactaaaaatgcaaaattagccgggcatggtggcacatgcctgtaatcccagctacttgggaggctgaggcaggagaatcacttgaacctgggaggcggaggttgtggtgagccaagatcacgccattggcactccagcctgggcaacaagagcgaaactccgtctcaaaaaaaaaaaatatgagtttgagtctatggcattttattata

SEQ ID NO: 39833 - DNA, 842 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactg

SEQ ID NO: 39834 - DNA, 2212 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttc

SEQ ID NO: 39835 - DNA, 2439 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagcttgtcaactatcattagtgttagcgtattttgtgtggcccaagataattcttccattgtggcccagggaagctgaaaggttggatacccttgttgtaaagtgtctggccgagttcccttttgaagtgtggcgttatgatggaaatatccactccggttgtgtgttggacctttctgtaaacatggaggtgcagtttaaatgagtacctgtcatctcttctctaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataattttctctcaaggtaagaaagcaaagtaaaaatgacaaataataaaataagataaaaattctccatcctccacagaagaaacacagaagtagggatcattcctttgttcaaccattggttgtagcgatattttggtttaaagatctcaaaagcagaaatgtccaacttgtaaatagtagaataagggtcatctatgtcaaaacctatgcatgaccaaacttgcacggctaacttcaaagtccagcagtgttgagagtacttatgtgttcagtctagttagacttcttctacctatttgtccttattgagcctattcctgtattgctcttaggaatatacctcgtaaccttagcaaaatgttgggaaattctctcaagctacagtagaactgttccctcttctgggccacttgatatcacttatcttttgggtttttcagggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttc

SEQ ID NO: 39836 - DNA, 1675 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataaaatcatatgaaagactgaataagttttatacattttgtttctttaaaaggtattacatattcttttgagctggagctgcaaggaaatacaaaaatttttaaaaagaaaagatattggatgctccttgtattctgtgaaagctctaagtatgggtttgtaggtgtaagagagggtggggctaagtgaatgtcaactgtagtaggtattcagtcagtctttctcaaagagaagtcaagcagactccctttaacctgtattctctttcctcccagaactatatctgactctcagtctgtcccataaattaattcagaaaccatcttcaggggaagcagatatcaactcacactattcacacaactgaaaatattgggcatcaaatagattagtgtgtgagaatcataaaataagttcctagacaacatttgttttacatgttagtcaactctgatcttccaggacaggtggtattagctccactgtcttaacatagtacgtggcacgttatgcctttcagtgttaactcctttctttttaaataaatgtttattggaggaaaaaagcactcagttgttccatgagttgttttgtactagactaaccgagtgctggttaaagggagggatgtcagcataaaaatgtcattccctcatcttcagtgtatgggttacattaagactgtcctttccagggccaatgttctgtgcatctaaatttttaaaatttaaaatgccatatttatgacatataaaaaagtataaagattactaatataaatactatactgcttcaaaaataaaactttgccaacacagctatgtgattcttaacagattattttaacacactgccttctctccctcagctgcatttgatattatacccacttatataatgggaactttacctagatacctgactttc

SEQ ID NO: 39837 - DNA, 1313 bp, Homo sapiens
cgccgagggacgcagagccacccacccccgggctcctacgcgcacgcgtgaaaaaagccaggtggaggggaacgggggagcttcgggcgtagagtgtggggagtgggggatctggtgcaaattagggtgcgtgaaagaagtcacaaaaagcgcagaggccaggcttcccgccctaatccggcctttgtctccgcccctctgcctttgtttcggcccaagcgtcttatggtcagacatcttcagccccagtggtccaagagccaaaggacggggtctgccccaagctgtgcctgcttccggagccgcaataagaacggtcaattgagatgcggctttcaggcatttgtttaggacatgcccatggcggggcttctaaaggggcttgtacggcaactggagcagttcagagttcaacaacaagcttccaagatgccgcccaaaggaaaaagtggttctggaaaagcggggaaagcttgtcaactatcattagtgttagcgtattttgtgtggcccaagataattcttccattgtggcccagggaagctgaaaggttggatacccttgttgtaaagtgtctggccgagttcccttttgaagtgtggcgttatgatggaaatatccactccggttgtgtgttggacctttctgtaaacatggaggtgcagtttaaatgagtacctgtcatctcttctctaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaaagtggattattttgcagatggctgatctcatctattcaatgttgattctattagttccaatttcagaaggtgacattttctgactttgtccccttaagcacaaacaaaaactatggatttttgtttttgttttcagaaaagagaaagtacaaggtgtgcttggggaacagcaaggaaaccagacagatgtgggggcgggtttgtaggggaactgctggatgtacctcattaatttgttcatttgttcagcacccacagggtgccagtgaacgggctaggtgctggggatagagtggtgaacaagatgagccttatgcacctcacagtctc

SEQ ID NO: 39838 - DNA, 996 bp, Homo sapiens
gctctgctctcccaggcactactgagcgcgctcgcggtcgccaggagcggattgggcccccgccgcgcgcaagccttggtgacaggggatggcgcggagctgcctctccgggaaagttggatctgtgcgcccagacatggaaaagggattaggacaccggcagatcttgccctcacagagcggaggtgggggccttggaagggcacaccgcccgtaggcgcgaaatccaagaagaaaatgacactcatcagccagcctcgcgcggggagaaagggcggggtgggggtagtggcaccctgcccgtcctctcccacccccacagtccgggcccacagtccaggagtcacaagggatgtgaatccccaggcataatgtgaacccccaacaaacccaaggcctcagaatgcgcctcacctctccctccccaccagcagaaacatcctcccactctcccaacccctgctccagccacgccaaccctttaaccttgtcccagaatgtctaaactgtatctgcctctgtgcctgtgcacatgaagttgccttggcccggcgtttgctccacagccttctgccaaactcctactgcttgatggctggaagccttcgcaccctggcgctctcctcccaggtcagcagtcactggccttcctgtgcatccagcccagctttgaacagtcctgggccccaacccttatctttttccgagtaattacatggttgcatgattggcttcaccgcctctggatcagatgagcgctactaatgaaggatacaagttgtaaaactaggttttatgtgaactccagtcatcacagtttaggtgcggctagcgattttacagatgcggggttagtaactggcccaaatccagggcttccgggatgctgttttccttttttgtttcttagcagggatggcagatgtttgtagaacagatccgtgtaaaagtcagtatcctaagagattaaattgtaaagcaggacaagatagttaa

SEQ ID NO: 39839 - DNA, 984 bp, Homo sapiens
gctctgctctcccaggcactactgagcgcgctcgcggtcgccaggagcggattgggcccccgccgcgcgcaagccttggtgacaggggatggcgcggagctgcctctccgggaaagttggatctgtgcgcccagacatggaaaagggattaggacaccggcagatcttgccctcacagagcggaggtgggggccttggaagggcacaccgcccgtaggcgcgaaatccaagaagaaaatgacactcatcagccagcctcgcgcggggagaaagggcggggtgggggtagtggcaccctgcccgtcctctcccacccccacaagtccaggagtcacaagggatgtgaatccccaggcataatgtgaacccccaacaaacccaaggcctcagaatgcgcctcacctctccctccccaccagcagaaacatcctcccactctcccaacccctgctccagccacgccaaccctttaaccttgtcccagaatgtctaaactgtatctgcctctgtgcctgtgcacatgaagttgccttggcccggcgtttgctccacagccttctgccaaactcctactgcttgatggctggaagccttcgcaccctggcgctctcctcccaggtcagcagtcactggccttcctgtgcatccagcccagctttgaacagtcctgggccccaacccttatctttttccgagtaattacatggttgcatgattggcttcaccgcctctggatcagatgagcgctactaatgaaggatacaagttgtaaaactaggttttatgtgaactccagtcatcacagtttaggtgcggctagcgattttacagatgcggggttagtaactggcccaaatccagggcttccgggatgctgttttccttttttgtttcttagcagggatggcagatgtttgtagaacagatccgtgtaaaagtcagtatcctaagagattaaattgtaaagcaggacaagatagttaa

SEQ ID NO: 39840 - DNA, 470 bp, Homo sapiens
gtgacatcccacaggtgtttcagtgccacaaatttaaaccaccattggttaactgcatgagttctgtgctgagactgtttgaatcttggctgctctgcttaccagctgtgtgaccttgtcctcattttcctcagacttaaaatgggatcacaataatgcctacctcacataagtctgttggacagagtacataagacaacatatgtgaagagcctgacacatattatgttatgtacccactaaatgttatctgttacctacctcacctaaacctgttgtttatcttgtatctgtggatagcatcaccttcacccagacacttaagttggagagttcactataatctttaacaacacattttacctcaagccttaccctgtaccccatccaatcaattatgaactataaattctgtttctttaatagttcagaaatctttactacctaaagtctgatctccaggccaggtg

SEQ ID NO: 39841 - DNA, 413 bp, Homo sapiens
caggttcaagagatgtcatatctgacactacacttgtccatttccttagggacttcaatttagaagcacaaaaaaaggaaaagtacagatagagaaataaccattagtggtaataaggagtacaacttcatattttgatctttaactgctgacagcttttaagcctcactcctctctttctcttctccctgtgtgtgcccatcttaggcaccattgggagatttaagccccacaagccgttacctatccctcaaccccatatctatccacattaaaaaatccaagccagtctcctttctctgatccctcaagcaacttatggagcagcctgggagacctgacattttctttctggaaattctcattaagtaatacacctttgatatcaccttgtgtgtgtcatattcaatctc

SEQ ID NO: 39842 - DNA, 172 bp, Homo sapiens
tttttttagagcagttttaggttcaccgcaaaattgagaggaagatacagagatttcccatctactccatgccttcatacattatctactcctgtattatctactttctctttagttagcagatcaaaagaaataaagatcaagatggtgaaaattattgctttaaatgttg

SEQ ID NO: 39843 - DNA, 330 bp, Homo sapiens
cacacactctgtgttctagcccaacagaattaggcctatttactctgcacagcctgctcttttcaatctctgtggtacctttccctcacaatatatcctccaccctgagttctctttttgactatgactaggattcagtggcacctccatgaagtcttattggatgtgtccatatggaaatgcctctcttagcattccagggtcataattaagctacacttctggtgaagtgctgtggctcactcctataaacccagcactttgggaggccaaggcaggaggattgcttgaggccaggagttcaagaccagcctgggcaaaatagcaaga

SEQ ID NO: 39844 - DNA, 185 bp, Homo sapiens
ttaaatggactatattaaaattaaaaaactctgttcacaagagaaaaataccatcaggagggtaaaataagaccttgtaatgagattttaaaaaactttccaaaacacctcatacccagaatctacaaagtatacttacaatcaattatatttatatatttttaaaagacaccaaaaaaaaaaaa

SEQ ID NO: 39845 - DNA, 1144 bp, Homo sapiens
gcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 39846 - DNA, 982 bp, Homo sapiens
tcgaatcgtaaccgttcgtacgagaatcgctgtcctctccttgcggccgccagtgtggtggaattcgcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 39847 - DNA, 870 bp, Homo sapiens
tcgaatcgtaaccgttcgtacgagaatcgctgtcctctccttgcggccgccagtgtggtggaattcgcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagagtttgagatcagcctgggcaacatggcaagaacctgtcccaaattttaatataatacaacttttcactaacgctttttcacataaacttacgtcaaaatataccggagggccggtccggggaatttactgagcaaccttttttcctacaagaagttttatccgaaaaattctccg

SEQ ID NO: 39848 - DNA, 506 bp, Homo sapiens
tcgaatcgtaaccgttcgtacgagaatcgctgtcctctccttgcggccgccagtgtggtggaattcgcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacaagccttgaggatccttccaataaaggtgtcaagagctca

SEQ ID NO: 39849 - DNA, 1241 bp, Homo sapiens
gcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 39850 - DNA, 1117 bp, Homo sapiens
tcgaatcgtaaccgttcgtacgagaatcgctgtcctctccttgcggccgccagtgtggtggaattcgcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 39851 - DNA, 425 bp, Homo sapiens
attaaaaaaaaaaaaaaaaaagtctgaaagaaaagatctggaggcacattagcaggttttgccccacattttgagaaattggtatggttctgtgttaacagcaaggggtggggctggtccacttttcaacctacccttcacctcttagagctttgtgggatgtgatttgagactgcagtatgaatgcttaagaataaagacaatataggctgggcgcggtggctgatgcctgtaattccagcactttgggaagccgaggtgggcgggtcatgaggtcaggagttcgagacaagcctgcccagcatggtgagaccccgtctctactaaaaatacgaaaaaagtactggctgggcatggtggcttgtgcttgtcgtcccagctacttgagagcctgaggcaggagaattgtttgaacctggcaggtg

SEQ ID NO: 39852 - DNA, 372 bp, Homo sapiens
attagtgaaagttgcgacactgaaaacctcaaaaaatactctgccccatataaggaatgaggaaactggcaaagaatcagaagcaactctttcagaactctggaaattagccaaaagtttatagcaattgggtatggtttattaaagaaaaatgactgaatcttgataagaatagcaagctgttattttaacttgccctatacctatcctctcatctccagcacagcagaagccttgaaaaccagcaggcttatagccagtggtgggggcagtaaggggttggagctccttcaaaaacttactatcagacagttgtcattatttgacttctcaggtggttccctggaagaccctacttacaaggctgtttta

SEQ ID NO: 39853 - DNA, 493 bp, Homo sapiens
ttcactaattcattcttgttctagcgaaaaatatttaataacatactataagtaaatttctaatttgactaaatataataattggaataaagcatggcataaacaaatatgaacacccagatatagattgacaggtttctcattacagtgaactattagggactgctattaactaaaactttgactttcttttttattttgaagaaaagctttaccttttcacctgttcagagctcatggctgcttctgcagctgctggctctgggagtttgtaataaggaagatattaattgccttcttaacatctgtttttcaaatgctgccctatatgctagggacagacttaaaaaacagttgtttaagcatgcacttattaatatttaaacatttggctccatatactccttaactcctctaaggaagaagcatattgttgtgctggcaaccctccatgtaactccaaataatgaaatgttctattctcaaaaaaaaa

SEQ ID NO: 39854 - DNA, 596 bp, Homo sapiens
cctctcccactcgctctcttgcacgctctctctccttcccaatgcagggaactcaagctgaacttgatccctttgcagttcaaaggtgagcaaaccaggctcggagcacaggcgacgttagccggcgaaagcgcacggccgggcgtccccaacggcaattaacaaagatgcccaattctgtctggatttccgaagaaaagccaaaggctttcgggcgggggtggagggggaggtggagtcagagacagctgccaagtagcttaaaaaaaaaaatccagtttgccaaggggagaaaaagtgtcagtcggttgtggcctcggaagtgccctggcacggctggtgaattccgcagttgtctcgtcccttttcgcgtctgggagagtctggtgcgggcgctcccgccgcccctcgggctgcagcggctcggagacactgaaccgctagtgggaatctcccgttcgctacccgcgagcaggaaacccgcaagttgcccaaagtggtggttgctgctgggtgctcgctcgctcacggatcaggcttgtccctgacgctgctgctgcagcggcggcggcagtagcagccgagccgccgaaact

SEQ ID NO: 39855 - DNA, 1359 bp, Homo sapiens
  misc_feature (1359)..(1359): n is a, c, g, or t
ggattggtgtgaggaggggccagagcccgcgggcgtcccgggccgaggcgcgggagaggcggtggacaccgagaagcccgccggcggcttgcaattccctcacccggcgcgcgcctttcgcagagggaaggagcaagagggcccctacctcatcgtgcgcgggtggggtcggcgcttgtcgcgtgtggcgcgcagtggggcgggcggcgggaggggggtggcagtggagggagcgagaggtgcaggggtgactttgttggcagcaggactagctggagagctagacctggaagcgcatccggggaggacttgcggggcagaggagggcgtgggcgtgtctggtatgggatgcagtggaaaggagggggccctcctgagtagatctgtgggtgattccttcgaggacgcctcgtcttcccgtctgcccttttatttgtcagcgagggagtccccatggtctctgttcaagttctggaaactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaaagcgccggctcgttgggtcaatagtacttgccgcagtactcttaaaactaggcggctatggtataatacgcctcacactcattctcacccctggn

SEQ ID NO: 39856 - DNA, 2432 bp, Homo sapiens
ggattggtgtgaggaggggccagagcccgcgggcgtcccgggccgaggcgcgggagaggcggtggacaccgagaagcccgccggcggcttgcaattccctcacccggcgcgcgcctttcgcagagggaaggagcaagagggcccctacctcatcgtgcgcgggtggggtcggcgcttgtcgcgtgtggcgcgcagtggggcgggcggcgggaggggggtggcagtggagggagcgagaggtgcaggggtgactttgttggcagcaggactagctggagagctagacctggaagcgcatccggggaggacttgcggggcagaggagggcgtgggcgtgtctggtatgggatgcagtggaaaggagggggccctcctgagtagatctgtgggtgattccttcgaggacgcctcgtcttcccgtctgcccttttatttgtcagcgagggagtccccatggtctctgttcaagttctggaaactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatggtacgattaataccaaagaggttgatccagccaaatgtgtcctacaaggagaagacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgacggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactg

SEQ ID NO: 39857 - DNA, 1745 bp, Homo sapiens
ggattggtgtgaggaggggccagagcccgcgggcgtcccgggccgaggcgcgggagaggcggtggacaccgagaagcccgccggcggcttgcaattccctcacccggcgcgcgcctttcgcagagggaaggagcaagagggcccctacctcatcgtgcgcgggtggggtcggcgcttgtcgcgtgtggcgcgcagtggggcgggcggcgggaggggggtggcagtggagggagcgagaggtgcaggggtgactttgttggcagcaggactagctggagagctagacctggaagcgcatccggggaggacttgcggggcagaggagggcgtgggcgtgtctggtatgggatgcagtggaaaggagggggccctcctgagtagatctgtgggtgattccttcgaggacgcctcgtcttcccgtctgcccttttatttgtcagcgagggagtccccatggtctctgttcaagttctggaaactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacggctcgccattcactgtgacggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactg

SEQ ID NO: 39858 - DNA, 727 bp, Homo sapiens
ccactcttctgtgattctggctgagcaagttcatgccggtagaggctcattaagtgaggtcctgggcaccccccaaacaggaagtgttttcaggcccttacatgcttatccttaaggtgagtaggtatctcagcagcacacccgaacagtaaaggtgatcaataatgaaactgtagttttcagattgaagaatgaacctggatcaccaaactagataccgaaagggctcctcatttgtctcttttgtcccattgtgggcatatggtgggctccttgagaggagggagtctcagctggggcctggctgcagagacctgctcttgaatagggctgcctttgggatcagggagccgagcatactgggcaaggctcatcatgttcctttgtggaagtggttacttggtgggggtggggtggggaaggggggtcataggaagccgaagctgagtgcgcactagagctgctagcaggcaggccagagggtcagcttgtgttttattttctgatttctcctgcatgctttctggagatgaggattttttgtcaggtagctaggagagcactgccaccttgtgtccatatagcacaatgtttctctttcctattcacagacaagattcaagaaaccatttttacgtgtgtacattcaaatcttcatgaatggcatcacttgctttagacccattttttttttattggtcagaaataaaatgtgactgcaactgtg

SEQ ID NO: 39859 - DNA, 287 bp, Homo sapiens
atcaagtgctcctacaaaaaaaaactcatctgactaaatcactgactttgctgttttttttttctaactttttcattttcaatcttcacagcaaatgtattttttgtttcagggcctggaagaggtattttttcctcagaaagaagctaacattaatgtgtgttgggcactgtctgatgccttggctctaactccaagtaagctgccctggtcttctaagtactctacagagtgcaaaggcttaccaaatccaaaccaccttgaattaaacaaatcttaatgaggag

SEQ ID NO: 39860 - DNA, 433 bp, Homo sapiens
  misc_feature (404)..(404): n is a, c, g, or t
gatctcgactcactgcagcctccacctcccgggttcaagcgattctcctgcctcagcctctcgagtagctgggattacagtcatgtgccaccacacccagctaattttgtatttttagtagagacagggtttctccatgttggtcgagggtgttctcaaactcccaacctcaggtgatccacctgcctcggcttcccaaagtgctgggattataggggtgagccaccacacctggccccaggtgatccttctagtggccgatacctagagtaggactggaggcacatccacattaggagaaaggctgtgcttttgaaagtgaagaagttgtgaggtgatgatggtatgatcagaggaaaaagaaaaacgaggggattcttgggtacttcgcagagtgctggcancggttccctactgcatttcatgtcgacgc

SEQ ID NO: 39861 - DNA, 412 bp, Homo sapiens
gggagacatgttccattttggtctgtgggatctgcatttcttccttatagttatggctcatagagatgactgctctttcaaaggtggttgtggtctattagagcgtttccaatgtccccatacttctttctcgagtgctagtcaaaagcgacttgcagatggtatggaatgtctttgtgagatagaaagaacacagactaggatcagaaaaatctgcctcccaaccctccatggccatcttctggctgtgtgactttaccgccctaactctttaaaatagccccacacctacctgccaggattgtcttcagaattacataaaataacacataccaaagtctctaggaataggagcatgttcacataataggactcaacaagggtcagcatctcttctttctttttgggatga

SEQ ID NO: 39862 - DNA, 900 bp, Homo sapiens
cagattgagaacctctcttcccatttggcgtgctttcttctgattgatccccacccttcacctattttacacatatcctttcctaattgtttttttacactgttgtacctacctttgagtggtgctgttgttttagccttttttgcatactcacaaaccaatcagcatgcacgccttcattctgagcccataaaagctgtggactcagccgcactgagagagagaccacctgactttgagtgagggaccacccttgcatcctctctctcctgagagctgtttcatagttcaaataaaactcttctccaccctcctcaccctttgattgtcagcgtaacctcattcttggacgctgaagaaaaattcgggacccaccaaacgcagatacaaagaaggctgtacacactgtggccctttgccctctgctggtggagggcaaccgtcccacacaacgcgatgggaagcagcagtggggcagagccagtcctgaagccacgggcctgagtggggcaatgggactgatagagctgttaacatgccactgtccgttggcctgcagacggcagaactaaaagagtgcttagcatactgtaacacctctggggcttcagggtcatgagcacccctgtttgggtgccaccacatttccctcaatgtgacacacctggtccagccacaagccccgcacagagcccactcctgccctgtactcgttcactcacacaccccctcctgccaggggctgaggccatggtggctgcaggattcgtgcctgagcacaagccagacacatcctggtgggccgagtagttggggtgttgctggccggaggtctccagctgtcaaagtggccaagaaaaatcctgcatcaactgtacaaatgtaccctaatttatttaa

SEQ ID NO: 39863 - DNA, 616 bp, Homo sapiens
atattcggaacgagtgattttctataaccttcatacaaagaggagacatgggatcttacccttttctctaatcccagctaaaactgacagtatcctttctattggctgatgtgtggcatgagagtcgttattgcaactgttagttggaccaagatatatgtcacagtcttacctgtgggtagggagcaaacaggagagtcacatcacctgtattctgggccaggaatatgtcacaatcttccctgacacaagggaccaggcagaagagtcacatcacctggggtactcagccagggaatacgttacaacccctgcagggttgcaggctgcagagtcacctcaccttcagtaataagcccagcaatatgtcaaaatgctttctgtgggcaaggcccaattacgagagacacatcgtctgtttgctgatgccagcaatatgtcacaatcttccctgtaagcagggttcagggagaagaagacagccacatctcttaggtgattaatgcagagatatgtcaccagatccactgtggacaggcccccagcggagccttccattttctaggtattgggcccagcaatatgtcacaaaacccaaaacatgtggggaccaggc

SEQ ID NO: 39864 - DNA, 674 bp, Homo sapiens
agaagagaattctaattttccacctatatagcttataaaatctgaaagttgtttatatttggagttgagatgtcaaagaagggaacgaattccattggtatggttggctttttatataatatgtctatttacatggatgtttaagctggttgcttgaataaattcaaatttttagtaatttcaaagagtttaggtgatttaatatagtcatgcgaaagaatctcaagactagagggtcttatcattgggcaaattcatgtgctggaaatggaaggtagagaaataacgtgatttaatgtcatactaattctacattctgggagaatttactttatttaaaatatagtgaagaaccttgaacatagtcatgtgatttgtacgaagatgcctagaacatggaaatatatactctaataaaaaaaattttttaaatctgctaggaagttttaaatgcacgttaacattcagaatgatatatagaatcaaagaaaccatttgcatgatttatacctttaaaataaatctgaatttggctacaattaattgaagagtaatggaataagtatttttttgaattatttgaatttcctaagacaggtcattccttcattgtatgttttacttgggtaggtctgagcacatctcattacttattaaagcttatttgattgtgc

SEQ ID NO: 39865 - DNA, 730 bp, Homo sapiens
gctcactgcaacctccgtctcccaggtttaagcaattctgcctcagcctcccgagtagctgggattacaggcatgcaccactatacccatctaattttgtatgtttagcagagatggggtttctccatgtagatcaggctggtcttgaactcctgaccttgtaatctgcccacctcagcctcccaaagtgctgggattacaggcatgagccaccacgctcagccactagtcctcagatcttaacacacataagataattcatactggaaagaaactccacaaaccagaaagatgcaataatgcttttgacaacacctcaagcttttctaaccataaaaagaatcatattggtgagaaatcctagaaatgtgaagaatgtgacaaagtctttaaatggttgtcatacttgacttttttctttttttgagatgaagtctcactcttgtcccccaggctggtgtgcaatggcatgatgtcggctcactgcaaactccgcctcccaggttcaagtgattctcctacctcagcctcccaagtagctgggattacaggcacctgccaccacgcctggctaatttttgtacttttagtagagatggggtatgaccatcttggccaggctggtctcaaactcctgacctcaggtgatccgcccacctcgggcctcccaaagtgctgggattacaggcatgagccaccactccctgccttacttgattacattcaatat

SEQ ID NO: 39866 - DNA, 1790 bp, Homo sapiens
cgcgcaggctgcggtcgcgcaggcgcagtcggggcgccttcccggtataggcgccttttaccccagcgtgtcctgagtctttggttcgcgaagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcaccctgctagtgatgcaaccctgtgctgggcaggacgaggctgcggcccccgggggcagcgttggggcgggcaagcccgttaggtacctgtgcgaaggggccggggatggcgaagaggaggctggggaggacgaggcggacctgttagacacttcggaccctccggggggaggcgagagcgcggctagtttggaggatctagaggacgaggagactcactcggggggcgagggcagcagcgggggcgcccggaggcggggcagcggtgggggcagcatgagcaagacctgcacctacgaaggctgcagcgagaccacgagccaggtggccaagcagcgcaaaccgtggatgtgcaagaaacaccgcaacaagatgtacaaggacaagtataaaaagaagaagagcgaccaggccctgaactgcggtgggactgcctcgactggcagcgcgggaaacgtcaaactcgaggaaagtgcagataacatactctccattgttaaacaaagaacaggatcttttggggatcgtcctgcaagacctactcttttagaacaagtgttaaatcaaaaatcgttactaagaagtccagaagtagtgcaatttttacagaaacagcaacagctattaaatcagcaagttttggagcaaagacaacagcagtttccaggaacatcaatttaagactgaagctgtcaaagaggaaaactttaaaactttaaaaaggcaaacctaccaataggaataacaaattaaatgtcaagagagtatatccaatattaggatataaatgtatgtgtctcaagtttaactctacaaaaatttgttacttgttttttaaactctatatataaagttcgacttaatcatggctgttctaagaagtacttatggagagcaagaacgtttttgttcatttcttaatgtgtgtgtttttacttgcatatctgttcaaaacacttttaacaaaattaattcattaaagtccagttgttgacctttgaagttagctgatttctttattctgttctttagtttattcttactagatgcagaggaattcatctactgtctgttattaactgttagtttattctcatacttacgatgttgagagtttttttgaagcttaagttaccctttatggtggaaaacattagcttatgcttctttagatggaataatgggaaaggagggaaatgggaaatggatggaaatgggaaaggagggaaaataatagcccagtgagagctgaatgaaaagggactgaatttaaatatttgtaagaactttgtgatgatgagtaattgtcagacgtgggatagataactgagaggctcagaatctttaccaaggatattttttaggataaggtagctgcctgttcatgaatttggataagaatagtaggacaatattcaacacaatttaatttttgtctgccacattagacatttttttaccttataaaatgatcaataaagcaataaggtttattttgggta

SEQ ID NO: 39867 - DNA, 2773 bp, Homo sapiens
cgcgcaggctgcggtcgcgcaggcgcagtcggggcgccttcccggtataggcgccttttaccccagcgtgtcctgagtctttggttcgcgaagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcaccctgctagtgatgcaaccctgtgctgggcaggacgaggctgcggcccccgggggcagcgttggggcgggcaagcccgttaggtacctgtgcgaaggggccggggatggcgaagaggaggctggggaggacgaggcggacctgttagacacttcggaccctccggggggaggcgagagcgcggctagtttggaggatctagaggacgaggagactcactcggggggcgagggcagcagcgggggcgcccggaggcggggcagcggtgggggcagcatgagcaagacctgcacctacgaaggctgcagcgagaccacgagccaggtggccaagcagcgcaaaccgtggatgtgcaagaaacaccgcaacaagatgtacaaggacaagtataaaaagaagaagagcgaccaggccctgaactgcggtgggactgcctcgactggcagcgcgggaaacgtcaaactcgaggaaagtgcagataacatactctccattgttaaacaaagaacaggatcttttggggatcgtcctgcaagacctactcttttagaacaagtgttaaatcaaaaacaacagctattaaatcagcaagttttggagcaaagacaacagcagtttccaggaacatcaatgtgagggaacttaccaagcatctacatggtttttatcttattgtaatagatgagcatatttttttaccagacataaatggggtaataatctatgcctgtagaacataaacattttcctgtaaatgtatgtgtgcatttggggataagtaagtattgcactttgtcatactaatctttcagattactgtgagtttgaagaagtcagcttatctttccaaataacatttaattataatgttttttaaaaaatatattcctcttcagtcattgttactgaaggtaatgaagcagttactttctgtggaagtcataaagttaatagatattaatcttgactcatctagctcagtggttctcatcaagggtcaatttgattgtcatagtgaccttgaaaaccactggcttttagtgagtggccaggaatgctaaatgttctgcagtgtcaggggtagtcccacatactaaagattgtctcacccgcagtgccaataacactcctaagaaatgttgatggctattttgtggtgctaacatgtagttggggcacctacaattgggttctcttaataacctttctttgcagttaagactgaagctgtcaaagaggtaagcacattttatatagacgtaaggaaagtgattattgtttaatatctgtgaatttaggatgtgcatctcttttcagaggtgtgttagtaaaacctgacggattaactaagcacactgggatgtgtctcctacagttggcttctctctttgatgttacctgttagtgctgatctcttaaagcagacatttcttgtttgttgaatttgtgaacagtatagatctcagcccaccaatgccaagacaaaattatttttcttatacttattttttattaaacaaaatgaaaaagatccttttcaaaaaggtgatcctgaaaataaaactaacactccagtattttgtcattgtttttcgcaattgagctatctgaaaactgttattcctaagtaatgttcaaaaatgataagtaatctggatacctttttcttatactttctcctaggaaaactttaaaactttaaaaaggcaaacctaccaataggaataacaaattaaatgtcaagagagtatatccaatattaggatataaatgtatgtgtctcaagtttaactctacaaaaatttgttacttgttttttaaactctatatataaagttcgacttaatcatggctgttctaagaagtacttatggagagcaagaacgtttttgttcatttcttaatgtgtgtgtttttacttgcatatctgttcaaaacacttttaacaaaattaattcattaaagtccagttgttgacctttgaagttagctgatttctttattctgttctttagtttattcttactagatgcagaggaattcatctactgtctgttattaactgttagtttattctcatacttacgatgttgagagtttttttgaagcttaagttaccctttatggtggaaaacattagcttatgcttctttagatggaataatgggaaaggagggaaatgggaaatggatggaaatgggaaaggagggaaaataatagcccagtgagagctgaatgaaaagggactgaatttaaatatttgtaagaactttgtgatgatgagtaattgtcagacgtgggatagataactgagaggctcagaatctttaccaaggatattttttaggataaggtagctgcctgttcatgaatttggataagaatagtaggacaatattcaacacaatttaatttttgtctgccacattagacatttttttaccttataaaatgatcaataaagcaataaggtttattttgggta

SEQ ID NO: 39868 - DNA, 2818 bp, Homo sapiens
cgcgcaggctgcggtcgcgcaggcgcagtcggggcgccttcccggtataggcgccttttaccccagcgtgtcctgagtctttggttcgcgaagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcaccctgctagtgatgcaaccctgtgctgggcaggacgaggctgcggcccccgggggcagcgttggggcgggcaagcccgttaggtacctgtgcgaaggggccggggatggcgaagaggaggctggggaggacgaggcggacctgttagacacttcggaccctccggggggaggcgagagcgcggctagtttggaggatctagaggacgaggagactcactcggggggcgagggcagcagcgggggcgcccggaggcggggcagcggtgggggcagcatgagcaagacctgcacctacgaaggctgcagcgagaccacgagccaggtggccaagcagcgcaaaccgtggatgtgcaagaaacaccgcaacaagatgtacaaggacaagtataaaaagaagaagagcgaccaggccctgaactgcggtgggactgcctcgactggcagcgcgggaaacgtcaaactcgaggaaagtgcagataacatactctccattgttaaacaaagaacaggatcttttggggatcgtcctgcaagacctactcttttagaacaagtgttaaatcaaaaatcgttactaagaagtccagaagtagtgcaatttttacagaaacagcaacagctattaaatcagcaagttttggagcaaagacaacagcagtttccaggaacatcaatgtgagggaacttaccaagcatctacatggtttttatcttattgtaatagatgagcatatttttttaccagacataaatggggtaataatctatgcctgtagaacataaacattttcctgtaaatgtatgtgtgcatttggggataagtaagtattgcactttgtcatactaatctttcagattactgtgagtttgaagaagtcagcttatctttccaaataacatttaattataatgttttttaaaaaatatattcctcttcagtcattgttactgaaggtaatgaagcagttactttctgtggaagtcataaagttaatagatattaatcttgactcatctagctcagtggttctcatcaagggtcaatttgattgtcatagtgaccttgaaaaccactggcttttagtgagtggccaggaatgctaaatgttctgcagtgtcaggggtagtcccacatactaaagattgtctcacccgcagtgccaataacactcctaagaaatgttgatggctattttgtggtgctaacatgtagttggggcacctacaattgggttctcttaataacctttctttgcagttaagactgaagctgtcaaagaggtaagcacattttatatagacgtaaggaaagtgattattgtttaatatctgtgaatttaggatgtgcatctcttttcagaggtgtgttagtaaaacctgacggattaactaagcacactgggatgtgtctcctacagttggcttctctctttgatgttacctgttagtgctgatctcttaaagcagacatttcttgtttgttgaatttgtgaacagtatagatctcagcccaccaatgccaagacaaaattatttttcttatacttattttttattaaacaaaatgaaaaagatccttttcaaaaaggtgatcctgaaaataaaactaacactccagtattttgtcattgtttttcgcaattgagctatctgaaaactgttattcctaagtaatgttcaaaaatgataagtaatctggatacctttttcttatactttctcctaggaaaactttaaaactttaaaaaggcaaacctaccaataggaataacaaattaaatgtcaagagagtatatccaatattaggatataaatgtatgtgtctcaagtttaactctacaaaaatttgttacttgttttttaaactctatatataaagttcgacttaatcatggctgttctaagaagtacttatggagagcaagaacgtttttgttcatttcttaatgtgtgtgtttttacttgcatatctgttcaaaacacttttaacaaaattaattcattaaagtccagttgttgacctttgaagttagctgatttctttattctgttctttagtttattcttactagatgcagaggaattcatctactgtctgttattaactgttagtttattctcatacttacgatgttgagagtttttttgaagcttaagttaccctttatggtggaaaacattagcttatgcttctttagatggaataatgggaaaggagggaaatgggaaatggatggaaatgggaaaggagggaaaataatagcccagtgagagctgaatgaaaagggactgaatttaaatatttgtaagaactttgtgatgatgagtaattgtcagacgtgggatagataactgagaggctcagaatctttaccaaggatattttttaggataaggtagctgcctgttcatgaatttggataagaatagtaggacaatattcaacacaatttaatttttgtctgccacattagacatttttttaccttataaaatgatcaataaagcaataaggtttattttgggta

SEQ ID NO: 39869 - DNA, 1226 bp, Homo sapiens
  misc_feature (1225)..(1226): n is a, c, g, or t
gcgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaatgtaagtctggatgtttcaattgttttttgcctgtattacatttatttcaattgaaacattccttccttctcccatctggattcctaagtctgctaaatgtggcaaggtttctcagtctttgcactatgacatttttagggttgagtaattgttgtgaggagtgttccgtatattataggatatttagcaatatatttgacctccactcgctagacctcagtagcacctcccagtcataacaaccaaaaatctccagacattgccaattgtcccccagaggggctctccacccctcacactccattgtgagccactattctgtagtatgaacagatctgttagccttataataatatattatgcattgttttgaatttctctttccaaagtatttcctatactgcaaaattttataatacttggaactttcatatttatggcaattacattggtcagcaacactgaagaattataactaagcttgcattttgaaaaagagactggtacttagaggagatctttccagaaaagtaaatttattgtttttttatttttaaatgattgccaaccaaagatataaccaagaaactctgtttttggggcaagaattggtgttatatcttcagcaagatgcagcccatgcttcattgtttatttattatttataaaatattgttttactaaaggggaagaacattataaaaatatattcaatttann

SEQ ID NO: 39870 - DNA, 551 bp, Homo sapiens
gcgggatagctttacggcttctgggagctgctgcttcgctgtgagaagtatccgcgacgagctatccgggaaagggccgaatgcgatcaaacctaatccgcgagacttgctaaaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaaaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgg

SEQ ID NO: 39871 - DNA, 437 bp, Homo sapiens
gcgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaaattctccaagccccgggtggtattgtccttttgagcccgatatcccaacc

SEQ ID NO: 39872 - DNA, 343 bp, Homo sapiens
ctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttagggtaatattttttagaactgtaaatttgatgttactccaagctaatgtaaatttttaatagagtatattgcaagtt

SEQ ID NO: 39873 - DNA, 823 bp, Homo sapiens
gcgggatagctttacggcttctgggagctgctgcttcgctgtgagaagtatccgcgacgagctatccgggaaagggccgaatgcgatcaaacctaatccgcgagacttgctaaggttctgtgctacaaattgatgtttagataaacttcagtgaaatgactcttcaggaattggtgcataaggctgcctcctgttatatggacagagtagctgtatgttttgatgaatgcaacaaccagcttccagtttactacacctacaagactgtggttaatgctgcttctgaattatcaaattttctgctgttacactgtgactttcaaggaattcgggaaattggtctctactgccaacctgggatagacttaccctcttggattttaggaattctccaagtcccggctgcttatgtacctatcgagccagattcaccaccgtcattatcaactcattttatgaaaaaatgtaatctaaagtatatccttgttgaaaaaaaacaaattaataaatttaaatcttttcatgaaacattattgaactatgatacatttacagtggaacataatgacctagtgctcttcagacttcactggaaaaatactgaggtgaacttgatgctaaatgatggaaaagagaaatatgaaaaaaaaaaataaaaagcataagttctgagcatgtcaatgaagaaaaagcagaagaacacatggatctgaggctaaagcattgcttagcctatgttctacatacatcagggactacagggataccgaagattgtcagagtgcctcataagtgtatagtaccaaatatccagcattttcgg

SEQ ID NO: 39874 - DNA, 301 bp, Homo sapiens
cagagagagagagagaatgaatgaaactaaaattttgcagcagaagagtacaataactaagttgaaaaaaatcactacactggtccaacagcaggcttgttcaagcagaagaaattatcagtgtaaagacaggttatttgaaattactgaattagaagagtaaaaagaaaaaaagaatataagatgttttatgtaagcctatagtaaccacaaagaaaatacatatagaagatacacaaaagaaaaagggaaagaaattaaaatatatcactacaaaacaatcaatgaaacaaaaaagaaa

SEQ ID NO: 39875 - DNA, 326 bp, Homo sapiens
ctaataaagaaacccataaatgattttatgaccactcaaaatatgtttgatgcctatatttttttaaattttaattaattaattttttttgagacggagtctcactctgttgctcgagctggagtgcagaggttgcagtgagccaagcaagactgagccactgtactccagccagggtgacagagggagactccatctcatctcaaaaaagaaagaaagagagagagagaagggaaagaaagaaaagaaagaaaaagaaagaaagaagaaagaaagaaagaaagaaagaaagaaagaaagaaagaaagaaagaaagaaaaaagaaa

SEQ ID NO: 39876 - DNA, 1478 bp, Homo sapiens
gtgattaagtgaaatgagatatgcaaaaggataaggttggaaataggtaataaatttggatttcaagcctgttttgtaggacagatggatctgtagctcaaaggagaggtaaaacctgaagataattatagatactttattattaaggctatgagaaggaatgacaatatttatggtgaattcagtgggtttcttaagtgagtttattatagtcaagagtgtcaagtgggtggacgtggtggctcacgcctgtaatcccagaactttgggaggctgaggcgggcagatcacctgaggtcgggagttcaaggccagccttaccaacatgacgaaaccccatctctactaaaaatacaaataatagccggacgtggtggcacatgcctataatcccagctattcaggaggctgaggcaggagaattgcttgaacctgggaagtggaggttgtggtgagctgagatcacgccattgcactccagcctgggcaaggagagaaactccgtctcaaaaaaaaaaaattaattaattaaaaaaaagagtgtcaagtgttatgggagattggttaggtaagtactgaaagtggatgattggctttggcggttagtttgtcttgtgtctgagagccatttgtatagtggcaaatgttagatttctggaggctgaggaatggaagttaggaaatgcagacaattaaaattcttacacctttacattttgctattttttcctcagtgttttcttttgtagcacttctgactggtttattatttgctttttccttacaatgacattgttattctatagcattctgttgaagatgtaattacattttctcaatctgtgatgtcaggttgctttttgaagtataaaggtttaagaaatacataattacatatgatttttaagtgatcttctcggtcttcagttgattttttccatatataaatttaaggtagattcattttacatttggtatcatgttaaaatgctcccaaaactacctactgtataataggtattgcaatattgttgatcaccttcaggatattattatcctgaaatgtctcccagtggtccaagctgggacagtttgagcaacaaaataaatatgagaggattggattataacctaaaaaataaagtcaatatctataaatccatgttgatttaaataaatgattgactaaataaatacttggcagaaaagaagcaaatcttccttacagaaaaattccaaataatatatgtagaacacactttcaggaggtggaacttaatttacctcttcttgaatatggactggactgctgacttttaaagaacagagtatgaagagggaaaagcagtaactttacagtgaagaggcctggcagacagcaccttaaccaagttcaaggttaacttcaccaatgataaggcatggtgatatcatgtactctctgatagaatgtgttaaatctaagcagaaaaaaaaaa

SEQ ID NO: 39877 - DNA, 4930 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatt

SEQ ID NO: 39878 - DNA, 620 bp, Homo sapiens
  misc_feature (105)..(105): n is a, c, g, or t
cgagctcggtacccgcaagctatccggttcaatgcgcctgacaaactactcttaaatgaaacagaatttacctccctacacagaatataccagacataccacacnaatattaaatagatctttggcacattatttataataaacctgttatattaatggaaataatgttattaataatgtataaaattagatatacaacaggaataaaaatttaatgaaaaaatttagaagcatgtgtccaagaagctatttttctcttttaaaagaagattgttggccaggtacagtgtattgaaccggatagcttgccggcaagctatcctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaccggatagctgccgggtcctctagtcac

SEQ ID NO: 39879 - DNA, 636 bp, Homo sapiens
aggagctgagtgatctaatcaaacaaattccttcagagaacatctgtgaaggcacagtggtaaattaactataactgcataactagaaagcctctttaacttattttttggtagtgctgactctacccaaatttcaccaataaaattaagtgtaatgctaataaaattagtaaattacaaagaaattatagtttttggtgtgtttacatatgaactatatagtactaaggaagtttaatcaataagttttaactttttaaatttgtatacaactttttaattatttcatattattcattatggaatttcttgactttctttcctctaaaggtagctcaagtggagtacagaaggctgtaacaagaacaaaaaggtatggctaatttgagctttaataaagctggctacaatatgaaaattcaattattttataaattattaagtaatcaatattaaaaatgaattattttctagaatctcttcctgcattttaattgtgtgttccttttcattctaggccaggattgatgacaaagtactcaacatcaaagaaaataaaaccaaacaatcccaaacatacccttgatatattttttaagtaaacattgaacattttatcattaatttttaattgaa

SEQ ID NO: 39880 - DNA, 536 bp, Homo sapiens
ttaatggtgtttcaatattatgttgtctaaaagtatgttaacttttttaaaaaattaaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatggtaagcaacttattaagactatcaaaccaagaagcagt

SEQ ID NO: 39881 - DNA, 4661 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatt

SEQ ID NO: 39882 - DNA, 5067 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggatttttcttcatccctttactttgagtctgtggatgtcattgcatgtgatatgggtctcctgaagacagcataccattggattttgcttctttatccaagttatcattctgtcttttaattggggtgtgcattcaagataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatt

SEQ ID NO: 39883 - DNA, 4867 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacgggggtccagattttatggaaatgagctcaagaaagaaaagcaagtcaaccaacgaattgaaaatatgatgcaacaaaaagctcaaatcaccagccaacagctaagaaaagcacaattacagcaattctacagaggaacatttacattatgctacagtatcttcagttgtaccttcctgttcagcataaacatcatatgccaaagaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatt

SEQ ID NO: 39884 - DNA, 2603 bp, Homo sapiens
aggagctgagtgatctaatcaaacaaattccttcagagaacatctgtgaaggcacagtggtaaattaactataactgcataactagaaagcctctttaacttattttttggtagtgctgactctacccaaatttcaccaataaaattaagtgtaatgctaataaaattagtaaattacaaagaaattatagtttttggtgtgtttacatatgaactatatagtactaaggaagtttaatcaataagttttaactttttaaatttgtatacaactttttaattatttcatattattcattatggaatttcttgactttctttcctctaaaggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatt

SEQ ID NO: 39885 - DNA, 2819 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaa

SEQ ID NO: 39886 - DNA, 2731 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaa

SEQ ID NO: 39887 - DNA, 2963 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggtatggctaatttgagctttaataaagctggctacaatatgaaaattcaattattttataaattattaagtaatcaatattaaaaatgaattattttctagaatctcttcctgcattttaattgtgtgttccttttcattctaggccaggattgatgacaaagtactcaacatcaaagaaaataaaaccaaacaatcccaaacatacccttgatatattttttaagtaaacattgaacattttatcattaatttttaattgaa

SEQ ID NO: 39888 - DNA, 1898 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggttcggatatctggtttcccaatgagagggcaggaacccaacaaggggcatattgggttttaaggcggaaacaagccgtagcactggtgtcttaagaaacgggcagatattggtaactctaaaggcctaaaagtccggaaacacgcgagggggtcccaaaacaggaggcgaacaaagaccgagaaacccctaccagac

SEQ ID NO: 39889 - DNA, 371 bp, Homo sapiens
gacattcagtgagataaataaagcggaagagcaatacagcctatgtcaagaactttgcagtgagcttgctcaggatctacagaaagaaagacttaaggtgctttattttgatatggtgtccttagtttttaagttttttaatagtaaaatgctaccttaaaagctagagttagattacacatttcttaaagatgaatacaaattaataaacgtcagaatagtgtattcctatccccaacagtcagatacaaatccaattctgacccatatctggagtctgtgatgaggtgattctatgaagaagcaccttatgagaatagagtggttcagtataattcagaggactttacttctgtacctcaggagtacat

SEQ ID NO: 39890 - DNA, 2606 bp, Homo sapiens
  misc_feature (1455)..(1455): n is a, c, g, or t
  misc_feature (1490)..(1490): n is a, c, g, or t
  misc_feature (1513)..(1513): n is a, c, g, or t
  misc_feature (1544)..(1544): n is a, c, g, or t
  misc_feature (1636)..(1636): n is a, c, g, or t
  misc_feature (2410)..(2410): n is a, c, g, or t
  misc_feature (2442)..(2442): n is a, c, g, or t
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggtatttaaaagagtattgatggccactgtagttataattttcagactggctaatttaagtgtaatattagtagtttctcattataaagtatatagtaacattttacttacttagtctttcattcaacttctaacaactttacctattcagaatagctgtgaacctagtaagtaaattggaattaagcagactatgagcctgaaggaaaaaaaagattatacgtttctttctttttttttttttttgagatggagtcttgctctgttgcccaggttggagtgcagtggggcgatctcattcagcttactgcaacctctgcctcctgggttcaagcgattctcctgcctcngcctcccaagtaggtgggactacaggcgcatgccnccatgcccagctaattttttgtnttttcagtagtgacggtgtttcaccatgttngccaggatggtctccatatcctgacctcatgatccgcccaccttggcctcccaaagtgctgggattacaggcctgagccaccgcgcccgacncataaatttcatatagctatctttttctagcacaaaatatatttttattggttttgcatgtaataacttgagtattagtttttccttgggagacttcaatcctgtccaagattacattgcaggagagaacccagacggccacaaggtaagagacaaaagaaatactaactagcaacatagcaatccagaacaatctggtaaaaggaaaaacaaatttacatatgttgataacccatgaggccatcactgtctcttaacataataactgttattcatcatgaggaccctgaactatcttgtaaaagccatattgtgattaggtaaatcttttctttctacaccaaagcatgagaatgaataatgcattttaggaagatctatataacaattaaaatgaactgtttaatgaatatatttgaatatagctatttcaaattatcttaattaggactcctagaaattgtgaaacatctttttgaaaaatagtaatttgttttgtgaataacataaaaaggatacaccatctaattatcattattttaaatatactgtaaccagaatctttgattttttgctttatgtggataatctacgcaaaagacattttcaaagagtaaacatccaccctaaattatattctgtatcttttcttagagatagatatagaaccactataaaaacaatctgggctgggcatgatggctcacgcctgtaatcccagcactttgggaggccgaagctcgtggactacctgaggtcaggagttcgagaccngcctgaccaatatggtgaaacccccatctctnctaaaaatacaaaaattagccaggcatggtgttgcgtgcctctaatcccagctactcgggaggctgagacaggagaatcgcttgaacccaggaggcggaggttgcagtgagccaagatcacgccattgcactccagcctgggcgacagagcaagactccatctg

SEQ ID NO: 39891 - DNA, 1697 bp, Homo sapiens
atctttttgaattgtcttatatgagtgagtactttgtggcagaagatctagacattttaataaaacattttaatacaaatatctagatattttagatacatatttaagtatctaagctgaggtgaaaggatcactcgaacccaggagtttgaggctgcattgagcaattttctcaccactgtacttcagcctgggcaacagagcaagaacctgtctcagtcaatcaataaatgtatgtatatatatatatgtatatatgtcagaccaccgtctgaaattgctgttcatgattggaaatcgaactggaaacccgaaggcaggagatgtatgctcccttgggatgtatggggaaatcacacagagctgttagtacttcagtcatgggatttgctctcatgctatgcatatgggcctcacaacttgtaaatgccactggaagatggcttatctaaggttccttattttgtggtctttcccccttagttctgcagtgagtggggcaaagcgtgtcactgaccttttgaatggaaaacactggaagccttagcgttcttaattcctgaaatgttcattttttcttctaagcaactgggcttcagaggagattagggcaggcaataacagtgttgacaccagggcaactgttttctcctgtttatgggtatttattcaacatctgctttctgctaagctccatggaaggcacagaggaaacacagcagagtccatgccttagagactttgtacctgatgaattgagtggtatcaggacaatgctatttaatgtttgatccatcccttctctaagcacatctcagatttctgtgctacctgatttaaccctttcagttcatagaacccagaaggataaggtgaaaagatagaccgggaaaagtaatgcaagtggccaagagtagcttccacttcaaagttcctcatgtgtgtgtgctaacattgtgacttctgttcagtcattgtcagtataaactgtacattggaatcatttgtagctttttaaaaaatgcctatgcctcaccctagacctaccacatcaaaatctcaggatagagtctcaagctaaaaagcctctatttgagccaggcttattggcacctgcctgtagtcccgtactcagaaggctgaagtgagaggatcgcttgaactcaggagtttaacgccagcagaggcaatagggcaaaatagcgagatctcatctctttaaaaaaaaaaaaaaagaaaagaaaagcggtttttgttttgtttgtttgtattttattttaattattttacatagagacaagatcgcactatattgcccaggctggtcttgaactcctggcctcaagtgatccacccgccttggcttcccaaagtgctgacattacaggcgtgagccaccatggccgaccccctgtttggttttgatatccagacaagggtagctttctggttgtttatgacagtagcagtgttgacaaacaactaattttaaagagagagagctctattggctaaggaaaaatgtatgagaaaagatcatagatttttaaaagtttttaagttttagtttgtgactttggctttgccaataaatcaacaaatacatgatgaatgcttactctattacagttggtcctctgtatccggaacatggattcaaccaatcacaaattgaaaatatttggggaaaaaaaaga

SEQ ID NO: 39892 - DNA, 864 bp, Homo sapiens
ctctcattaaatttaatagtacttgttgctttggtgtagtgaaatgaatgccttgatgaaattgcattgcaccatttttgaaagagagaatactcaaacgtgtcacttctgtttcttgcaagcaactgtgatcctgagctgtgcacacttctggttgggattatttctggtttctacttcctgtttgaagatgtggcatggagagtgtaagttgaagagatgagtgcggggctcatctatccctggaattgtctttcccacaatccctgacacagaatatgagccatacaggaattctgaagaaatgggtctcttgccacctcccagtaaaagattatttttttaaaaaaaaaggctctgctttgacctgaagtattttatctatcctcagtctcaggacactgttgatggaattaaggccaagcacatctgcaaaaaagacattgctggaggaggtgcaaagagctggaaaccaagtctccagtcctgggaaaagcagtggtatggaaaagcaatggaaagagcattttgaaaatgccattccactgttttctggcctttatgatttctgctgagaaatccactgttagtctgatggggtctccttcatagcaccaatgacctgaagagccttgttgaaggaagactccatctgatgactcagagcaagtattttttagtgtgttattgttattagcagaaagagggccataaaatacatggggcaagctgaatatatcttaggcaaaagaagaaaatattcaaattcttatgttattttatctaattattttatctctttttgtgtgtgacttataatgtgtgtattgtattaataaaagtatataaacatgtagtttacaa

SEQ ID NO: 39893 - DNA, 543 bp, Homo sapiens
ccctactgaagtccagaggcacttttctgaaaggctctgctttgacctgaagtattttatctatcctcagtctcaggacactgttgatggaattaaggccaagcacatctgcaaaaaagacattgctggaggaggtgcaaagagctggaaaccaagtctccagtcctgggaaaagcagtggtatggaaaagcaatggaaagagcattttgaaaatgccattccactgttttctggcctttatgatttctgctgagaaatccactgttagtctgatggggtctccttcatagcaccaatgacctgaagagccttgttgaaggaagactccatctgatgactcagagcaagtattttttagtgtgttattgttattagcagaaagagggccataaaatacatggggcaagctgaatatatcttaggcaaaagaagaaaatattcaaattcttatgttattttatctaattattttatctctttttgtgtgtgacttataatgtgtgtattgtattaataaaagtatataaacatgtagtttacaa

SEQ ID NO: 39894 - DNA, 507 bp, Homo sapiens
ctcctgggctctctgactgcagtcaggccaaggaccagggaacctgcatctgttcactagggccaagcacatctgcaaaaaagacattgctggaggaggtgcaaagagctggaaaccaagtctccagtcctgggaaaagcagtggtatggaaaagcaatggaaagagcattttgaaaatgccattccactgttttctggcctttatgatttctgctgagaaatccactgttagtctgatggggtctccttcatagcaccaatgacctgaagagccttgttgaaggaagactccatctgatgactcagagcaagtattttttagtgtgttattgttattagcagaaagagggccataaaatacatggggcaagctgaatatatcttaggcaaaagaagaaaatattcaaattcttatgttattttatctaattattttatctctttttgtgtgtgacttataatgtgtgtattgtattaataaaagtatataaacatgtagtttacaa

SEQ ID NO: 39895 - DNA, 562 bp, Homo sapiens
ctctcattaaatttaatagtacttgttgctttggtgtagtgaaatgaatgccttgatgaaattgcattgcaccatttttgaaagagagaatactcaaacgtgtcacttctgtttcttgcaagcaactgtgatcctgagctgtgcacacttctggttgggattatttctggtttctacttcctgtttgaagatgtggcatggagagtgtaagttgaagagatgagtgcggggctcatctatccctggaattgtctttcccacaatccctgacacagaatatgagccatacaggaattctgaagaaatgggtctcttgccacctcccagtaaaagattatttttttaaaaaaaaaggtaaatctaaacttgtgctttatcttgatatgaaaatacagacagcaatagaaaaatttaaaaattaactgggcatggtggtgcatacctgtaatatcagctacttgggaaactgaagtaagaggatcacttgaacccgggagtttgaggctacagtgacctgtcactgcagtccaggctgggcaagagagcaagaccctgtatctta

SEQ ID NO: 39896 - DNA, 625 bp, Homo sapiens
aaaagtttttaccctgaggtgttgctaattcatgaacctattctcttgacagtttttccctccaatataacctatatcttattaaatgtcttttcttcttctagattgtttccaatagtagctcaattttagctttgttcaggctccaaattagaaaaacgctgagattagccaaatatttgaacactgtaaggtattaatcagtttaatctgaaaaaaaaggtataagaacacttcctacagttccagaagagtgagctgtcctggctgagggttatttcataagcacctacatgtatggacactaatggtgagtcatcaccagaggaagatgaaaaatctggactctgtatttgtgttgatgccacatttcagggcaaaagttttgcatccagaccatgcactctagcatcctaagtccatggctgctgtggcagtggctcttttcacaccaaaaatggagggagaaaaccagctaactcctgggctctctgactgcagtcaggccaaggaccagggaacctgcatctgttcactagggtgaggatttaaagcatcttctgggttttcagatcctaccaagaaaagcttcagaggcagaccttgagtctctgtgaaccccatc

SEQ ID NO: 39897 - DNA, 363 bp, Homo sapiens
taatgataaagtgtagtccctaccttcctagaacttcgagaatggtggttagttgtgggtagaatagcacttttttttgttataatctacagtttagtatagtggccaacatctgacttaatgagctaaggcagttgttggtttacatattactttctagtgtgagaaaatgtcaatgtgtttcttcaacagtgagttttaaaaataactattgggtactaggcttagtacctgggtgatgaaataatctgtacaacaaactctgtgacatgagtttacctatataaataaataaaaaatagaagttaaaaaaaattttccttatgctaggactggggtgactaccaagtagcatgagtgagt

SEQ ID NO: 39898 - DNA, 374 bp, Homo sapiens
taaacctcttttctttataaactacccagcctcgggtattcctttatagcaacacaatggtctaagacaccctgaattcactgtaaactggattaaggttataagcttcagtagattcagcttgaatatttaggacagaattcttcactgggaatgctgtgtacttcatatggcattacatcttctgcaggtatttctggcaaataaatataagcatttatcttaagtacgtacttggaaatgaaatttctgagtcatagcatatacaaatgtagttttttcaagtggtcatatcagttttcacccttcaaattcatcctacaaacagagttccagtggctccacatcttcaccaacatttgaaattgtcagtc

SEQ ID NO: 39899 - DNA, 820 bp, Homo sapiens
aatcctttctgggaagcgtagtcttaggtgtctggagaagtcgcccggtttctgcttgctggtcgcgaaattttatagctataattaactcagggcggaacagctagcagaatcctcagcgttcgggcaaagggcagagaatccagccagaagcaacatgtagatctaatgaccttctccaggagtcgaggacccactacctcgctgaattctcagagtcaaaatgcgtctctacctgctggtcccagaacagtcccctgctgctgcattgaatgaatctcatctcacttcctcgagtcagccctacctatatttgatgatcacaaaccttatccttacgttgccagcagtaacattctgcatccctcacccactccactgtgtccttttcctcccactgatcttcactctgccttttctaggggaactctgaacagtatttctgagaaggggtaggtaatgtgcgctttgcttcagtctgagtggattccatcaacctctgcatagagcaggggtggaaagaaatcctgtgtcattgcagcttcttttcgatctaagctttcatggccttattatgtagtttacatgtttttgtcagacaacaggatgttttgcctatatcattctatttccctttctcaaatgttggagatgccatagtaattaatgaagtacaaatccattttaaaatatcttactcctggccaggcgcagtggctcacttctgtaatcccagcactttgggaggcggaggcgagcggatcacttgaggtcaggagtttgagaccagcctggccaacgtggtaaaaccccgtctcta

SEQ ID NO: 39900 - DNA, 804 bp, Homo sapiens
aatcctttctgggaagcgtagtcttaggtgtctggagaagtcgcccggtttctgcttgctggtcgcgaaattttatagctataattaactcagggcggaacagctagcagaatcctcagcgttcgggcaaagggcagagaatccagccagaagcaacatgtgtaagttgttacattcagtccgggctcagtgtcattcaattttacaaaattttgttgtgtgctgactctgccagcgactgtgctgagggctttgcccccaaaattgccttcgaaatgtagtgaggggggcgggcgtagtggctcactcctgtaatcccaccactgtgggaagccgaggcgggccgatcacctgaggtcaggagttcgagaccagcctggccaacatggtgaaacaccgttgttactaaaagtacaaaaattagccgggcgtggtggcggccgccttagtcctggctactcaggaggctgaggcaggagaatcgcttgaacccgggaggcggaggttgcagtaagcccatgtggcgccactgcattccgtcctgagcgacagagcgagactccgtctcaaaaaaataaataaacaaataaataaaagaaagaaagaaaagaaatgtagtgagggaagtagtgtgtggaaaagtaatacaataggaagccatgtagcagcgatcataaatgaactagagctaccaggtagcagcatcaatggctgaatctcagaaacacgatgttcagtgaaagaaggaagtctaacaacacttttgtaaagttcaaaccaagtaaaactaatgttgtttagaga

SEQ ID NO: 39901 - DNA, 421 bp, Homo sapiens
gtaaatggtttttgtatgtgtgaatgaatggaagactgaagttagttattatagatgagatattatggggccattccgagtccagtattcaaggagtttgcaaagttgcagatgacaagtttgctaatgtgtgctgagtgttcgtgcctagtagcatgttaagtggtttgcttgggttgtttcattcagtcctcacagcggactcgtgaattaagtgctgttattatcacgtttttgcagatgaggaaactgaggctcaaagaagataatgtgcccaaggtcaccttgctaggaaagagtggagctgagatttaaactgtgactttaagcccaagttcaaggcttcttactagttttaactacattcccataccccttttaatcaatcatgtaaataaaatcttaattcttttaaaaaatt

SEQ ID NO: 39902 - DNA, 633 bp, Homo sapiens
aatcctttctgggaagcgtagtcttaggtgtctggagaagtcgcccggtttctgcttgctggtcgcgaaattttatagctataattaactcagggcggaacagctagcagaatcctcagcgttcgggcaaagggcagagaatccagccagaagcaacatgtagatctaatgaccttctccaggagtcgaggacccactacctcgctgaattctcagagtcaaaatgcgtctctacctgctggtcccagaacagtcccctgctgctgcattgaatgaatctcatctcacttcctcgagtcagccctacctatatttgatgatcacaaaccttatccttacgttgccagcagtaacattctgcatccctcacccactccactgtgtccttttcctcccactgatcttcactctgccttttctaggggaactctgaacagtatttctgagaagggatgaggaaactgaggctcaaagaagataatgtgcccaaggtcaccttgctaggaaagagtggagctgagatttaaactgtgactttaagcccaagttcaaggcttcttactagttttaactacattcccataccccttttaatcaatcatgtaaataaaatcttaattcttttaaaaaatt

SEQ ID NO: 39903 - DNA, 368 bp, Homo sapiens
aatccagaattggaacccgggcagccttgctccagagtccggtctcacttaatgagtactagataattctctgcatgtcagatgggtacactcttcttgaacctgctagttcttttggagccagatctggggagggggagcaaggcaggagttgagcaaatagcaggaacagactgtgtgacacttgctgggaggctccgaggctccagctccctgagcttagaagtgcggagtttatctatcccctgcgcgattcctgggggaagggaaggacaggcgaaggggcatggcggggcagtcctggtgtctccaggaccagggtcagggggaggccagagcaattagcctggctgaggcctctgctaact

SEQ ID NO: 39904 - DNA, 478 bp, Homo sapiens
gagtatttgccattagtagatgaagtcagcatactatttttataggaattgaactacattaactaattgcttttctatttttgattttgatactgtttccgtttgattctgtttgatcaaatctgctgcagtcattttttagtttgaaagatcctaatacttctccctagctccacatttggaagactgtcaactcctgtggagtaatttgtcaagaatgtagagttcatgaaggtggacaacatctttataaagaccaagaacctagctcagtgccttcctttcagacgacaggcttaaaggaaaaaaaagttacgtgttgcacaacttcagtagttattcttggctttatggcggtccaggcatgttcttcacatggactgtgagaatataatgtggtaggggctccctggagctgagcagtgtggcgatggtgatgttgaaatacagtgggtggggaatggcaggtgagacagtt

SEQ ID NO: 39905 - DNA, 424 bp, Homo sapiens
aaaagtgcgggaaagttgagtaacgcaagcatccaactgatgcggagcacctgtactcactccagttccaaacacatttatttttaccaagttgctaagttgacagcagagcagacagctccagctttgctagggcattagaggaagagaacattgacttggagcattggggccacctttattatagaacacttaatgtagatattgtatagagtgaccagacaatttatacccaaaatgggatgtttttgtttaggacaaatattaaagtgccctgggcaagcagggacatatggactggtatttcgaggaaccttatctgatagggaatcatatagtgtttgtaggaagtgatcctttgggctgtggagctacattctgtcctgtaccaatatagtactgtcaactcaaagaaaggaagaaa

SEQ ID NO: 39906 - DNA, 388 bp, Homo sapiens
aaaaagagaacaatatcacatttaaagtacgagtgtctaagaggaagtttatagtgcatgcctcacattttaaattcagcaagaaagaacagggacatcctttttctcactggcaagtttgtaatctgtgtaaaacactaggtatgtttccataagctatttaaatgcaagtgacattcagaaagaagatccagggatgaacacttgtcatatgagtttcattttattcacactttgagagttgtgtttcacactcatatttgaataagaaacctccttggcatcatggaatgaaatgttttcaacaacaaaaaagtcacatgttgggtaaattgttaacacatttttcccttaaattttcaccacaactttaggaattgtactccca

SEQ ID NO: 39907 - DNA, 432 bp, Homo sapiens
caagaatcaaccattagtgaaaatgcacctaaaaccttttaaagtcacttatcacatctaattatctgataccaggtattataattatgctattatgtataattttagtaccatggcttagatcatgttaattcaccctatatgccatattgaatttctagcctaaaattatcaacatactgattgcagcaagactaaaaatgagcagtcaaagacagttattctaagagccttacaaacaagcatatttattcatttttgaatttattagacaattttttttctgagcaccaattttgtgctatgtaaggtactagattctggtgataacagtgacaaataatatgtccttgaggcacacacagtctacaggagagcagggttgggagagacaaatgttctaaatagggggccatgccacagtagagtgaa

SEQ ID NO: 39908 - DNA, 451 bp, Homo sapiens
agacaaaggtaaaataggacactttctgacctcaagttataatagtgagaaacaggcaaattctctcctttctcttcttcagggaaaccttccctagccttccctgatcttggtgatataccctatgtgcgtttttaatagtatgtgttcctgtgttaaatgctcccaagaagaggtaattttacatttatttgagtggttattttattaatttctgtcaccccccaatagactaaattccatgagtacaggggccatgtcagtttttgtgcagtcaatgtttgtaagggacaatgcctgcagtgaacacttctttttccaacattaataccttctccactgtacttcacaacctctgccatagtctcacaggtctcctgtgaacacgtcattgcattttttttgcctttaaacctttcttctaccattctccttcaactgaatgccagcc

SEQ ID NO: 39909 - DNA, 420 bp, Homo sapiens
gcgtcgacccccatcacaccccccaattgttaactaaatagcagagactcttggcaagtcacttaacctctctgtgcttctagtgataactacaataaaaacagtaccacctgcctaatctattacatgtgacaatactataacaatgtagatttattgactgtctactgcatgtcaagcacagggataaaagacacagtctttacttcaggcagctcaatctctagtagggggctgataccaaaataactgcagcgtggtgtgtaagtggttcatgcataggttacactggtgtcaggaagaaggagggtgaccaattgctgggagacagcaggagaaatgaggaaggactcacaggaagggaatacctgaactaggtcttagggaataaataagaccaccaccttttaaggggtgggc

SEQ ID NO: 39910 - DNA, 371 bp, Homo sapiens
aatttattaagcactataaatgccaagtcattaatgtatatatgtatatgtatgtgtgcatgtgtgcgtgtgtgtgtgtgtgtatatctttttttaaatagatacaaggtctcactatgttgcccaggctagtttcaaactcctgggttcaagtgatcctccagccttgcctctcataaaaatgataaaaataatcactcaggaattaatgtccatcaagaatctgtttcctcttggccagcaactaacacatcctccttcctgctaacttttccttcctggatccagcagcctccatgttgctgaaaccaatgggatctgctggaattaaaggtgtgggccactgcacccggccctaagtcattaattga

SEQ ID NO: 39911 - DNA, 299 bp, Homo sapiens
gagtggtggcaacttgattctaagtagcttttagaattatatgtaaactgattgcacctagtttctgttttaaataatatacatcttttaaatgctttggctaaattgtgggaaagatagtggtggcttaacagtttagtaaaatatctatatttgtcagcttttggccttaacttcaatcttgtctgacttcaagatacttgcacatcttttaaactggctaatttaagtaactttatagaatttttgtgacttatctctggaaatactttgtcatataaattctatatagaatatat

SEQ ID NO: 39912 - DNA, 442 bp, Homo sapiens
atagtgtattaacactactgtttggatttccaagagatcttgctagtatgcagcatcttattcatgtcacatgctttttctgaatttcaggacccgatacccagtctctagtgggtggatgctgaggacagcttggaaggtgccatgctaacaggggcctctcagagatgaggttctgatattgcactatcaaattctgacttgtcctatcccactccaagtcataggaagtcacctttatttaaatgtggtttgcttaaatgtacttgataattaaaaagaaacacacacacacaaatatattcacaactctatttcaaagaactatcttgtggcctcattgaatgtggcagagttgcagtgtggaaaagttaatgcagccactaatgcattcactcagctttgggggaagccctaaaacagatctgagcacagactggag

SEQ ID NO: 39913 - DNA, 232 bp, Homo sapiens
atattattggaacacagcctctcatattcattttaaatattgtctatggctgttttcacactacagtggcagtgttaggtagttgtgacagagaccattatggtctacaaagcctaaaatacttattaatgtcccttgacaaaaaatagtttcctgacctctgctgtagaacattacgactctaaagtttctcaatgtggtagtatgactatcaggttgttttatttcttaa

SEQ ID NO: 39914 - DNA, 1800 bp, Homo sapiens
agcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcaagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgtaagttgtaaaagcacagactgttctatatttgaaactgttttgtttaaagaaagcagtgtctcactggttgtagctttcatgggttctgaactaagtgtaatcatctcaccaaagctttttggctctcaaattaaagattgattagtttcaaaaagtg

SEQ ID NO: 39915 - DNA, 846 bp, Homo sapiens
  misc_feature (803)..(803): n is a, c, g, or t
  misc_feature (806)..(807): n is a, c, g, or t
  misc_feature (810)..(810): n is a, c, g, or t
caatttccattaagtaccagttttatttaaaagcaaataaattgtttttaagtaagtaatcgtttttatgacataaatttgtgttttcagtttgattcttaaaccatcaacatttgaattacctagttcgctgggcatgggcccagaagtttgccttttagcaagcatctagttggtaacttcgcacactaaatggacaagaagcccaatatgtgtctctgaatgggaagtgttatttaattcttcaactcgtcttttttcttaaccaaaaccagtatcttttattttctgcagtatataattttcttagaacaaattgtctatttctgaatctacattttaaaatccacataattttatctattataccaaagaggttggaaataaaggacggaaagggaatacaggcttggaataagatgatagtgaaatcacaaattgagatattgttctcccttgctctgtggcaacagaactcagaagataatgatagtgaaagcttatgcaaggaccattcactggtaaaatggtaggatacatgatactgccattgccacttctcccgcagtgcagtccctcacacaggctaaaaccatcagcactaccatatactcttgttcgaagctgcaagggaccagaaagcaccgcactggcacattacttctactttcctggtgactcctgcagattcgtaactcgggctccgctgacagtacagtccagttcatcttctatcaacccatcatccaccgatggagggagacggatttctttccttgctcaagcaacctgtggaggaggtntgnnctngggcccggcacagggaatattatcacccgaggcggg

SEQ ID NO: 39916 - DNA, 2319 bp, Homo sapiens
agcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcaagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgttcatcccagaggcctggtcggcctgcacagtcacctgtggtgtggggacccaggtgcgaatagtcaggtgccaggtgctcctgtctttctctcagtccgtggctgacctgcctattgacgagtgtgaagggcccaagccagcatcccagcgtgcctgttatgcaggcccatgcagcggggaaattcctgagttcaacccagacgagacagatgggctctttggtggcctgcaggatttcgacgagctgtatgactgggagtatgaggggttcaccaagtgctccgagtcctgtggaggaggtgtccaggaggctgtggtgagctgcttgaacaaacagactcgggagcctgctgaggagaacctgtgcgtgaccagccgccggcccccacagctcctgaagtcctgcaatttggatccctgcccagcaagaagcagtatcgactcagcatggaacgcctgcaacgttctttgttaggcaaccaagaggcctggcttctcatcctgctgtcaccaactagctctgtggcctagggcgaggtgtctgccctttatgtttccacatctgcaaagtgaactggttgtacctgatgatctgagatcccatgacttgctcacatgtcccatgattctttattttgtaggcagaagcattaaacagctactcctgctgctgtgt

SEQ ID NO: 39917 - DNA, 805 bp, Homo sapiens
agcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaagtaagtgctgatttgttctcattcaacttgtccagagggtttcaatgtctttgtgtaaatggtttacatagtctcactctctgaatcactcatctttacactttttagagtttgtaaatggtgaaagatttgaaaattaaggtatgatttcagtgaaaagtaccaagtgttgtattgtgcgaaggaaaagtagactagagttatttttctttccttgagtgtcacttgaatataaaagaataaaaatttttgaatagtgttaaaaa

SEQ ID NO: 39918 - DNA, 160 bp, Homo sapiens
gtgtccaggaggctgtggtgagctgcttgaacaaacagactcgggagcctgctgaggagaacctgtgcgtgaccagccgccggcccccacagctcctgaagtcctgcaatttggatccctgcccagcaaggtaagggatgtgtggcctgccctgctgtcc

SEQ ID NO: 39919 - DNA, 352 bp, Homo sapiens
ctatcgtgttgccttagctctctttcaagtcacaaacacagctggccttaagtatttatttaagcatctttatattcctgtttactttaaactccttgaattagccatgcaataatttgggtatgttgtattaagagctctaccacattatggttcagtcattgtataattaaacatgaggcatcaagaatcaaaagttactgttttacttgcctgctctctccattgtgtcattttacattttagtagtactgtgttttgtttattaaaaaaagtaaaatcaacaatatactatgaagctgaaaaatgatacagaagcctaaatcatttcttagtctagagatgcatttca

SEQ ID NO: 39920 - DNA, 254 bp, Homo sapiens
tgtccagcttcatttctcctctttggctaatgcatttagctcctggcacaccaactagttgaactgttacccaaatatgcttttccagtgctattctctctgcctggaatcccccttcccgccctcaccccctgacatgatcacgcaacttccacttctttaggggttaacttagatgtcatctctcaggcttcttccttgatccagtcctctctcacgtgtttttaaatgtaggttttattattattcaggta

SEQ ID NO: 39921 - DNA, 389 bp, Homo sapiens
tcctccaacttatcctctggaggaaggatggctcagagttctggaggcaagcagtcagagatcaaggtgttggcagggttggtttcttctgcagcctccctccttggcttgtggatgaccgtcttctccctgtgtcttcatgtaggctttctgtgtctgtgtgtgtctgtattttaatcttctcatcttaggaggacaccagtcaggttggactgggactcactctaataacctcactgtcacttaattacctgtctttcaagaccctgtccttgatagcagtcacattctgagctcctggcggttaggactttaacatatgaattctggcggaacacagttcagcccgtagtggaccctaaccaaaaagatcctggaatacccctgtt

SEQ ID NO: 39922 - DNA, 929 bp, Homo sapiens
aatggtgggaatataattggagaagatggatgggcacgcccaggctgcagccccattaatttaccatccggacagctaacaagcagaagcagcgtgtctcctgccgcctaattattttaggtaatggaaatgcttaatgttgtgtgaatgcagccagcctgagagccgacggctcccccgactgggactagggaagggagtcccgttccgtactaatggcagggagggagggtcgctccctgactcagtcccacctctggggctttggaggctgtttccacaggcctgacacccctgtccctagacaggcccacatcagggccttccccagcccagatctggcagccctgctccccgagcagcactgagtggcattccccctgtgcccacgtcactcagtctctacccttggggtcttcaaagtgtatgttggagggagggacaccctgagtgttagccattcatcagaatgaagtgtggtctccaagagggagagaaggagctgccacaggcaggttatcttccacgctctgtaatcttcatgggctgggaagctactgtcagggacagcatgtctgggggcacacttggtacagcctgggttgagcctcagacacactgcttcctagctgtttaatactaggcgagtttcttaacatccctgagcctcagttgttaccttctgtaaaacaggtatactatacgtatctgggaggattaggagataggactgcgtgaactaattcacagcaggtacttagtctatgcctggtacacagaaggcacaagtccaataaacagtagctgttggccgggcacagtggctcacgcctgtagtctcaacactttgggaggccaaggcaggagaattgcatatgtccaggagtttgagaccagcttggggaatataatgaaaccctgttctctcc

SEQ ID NO: 39923 - DNA, 432 bp, Homo sapiens
gccatggagcccaacctgtgatttctttgctgtgtacccccatttgatggataattttttggcatgttgataaacgtccagggtgtaaagtatcccagtatgaggggtaaagccccggattataataaatttgtcaaccttcaggttttccttgcctagccttttctgtgatatacaaagtgcacatacaactacatgggtaggagaattgttgaaataagttatcattgttcaaacaataatttgttggaaccaaatatcacccacaatgcaattgtctacctttaaagaatggccatagagtcaaaaactttcttttgaatcctggattcactatttatttgatgtgagatcacctttacttttataccatcaatttcctcagtgtaaagagtgtattattaaaattccctcgtacggtcaaaaaaaaat

SEQ ID NO: 39924 - DNA, 446 bp, Homo sapiens
ttccatcatatatagcagtattttctataacattaatttatgcactgtatattaactgctctcttttgagtataattttgaacttaacattattcccattattaaaaattactattctttttatgcttggctttttacaacttcttctgtggataacttttaagcttctcccctgtacctccaacattatatttcctgctataaaaccacccttccttttggccacaaaagaatgctctagacccaccttagatatattttttctgctgaagacagaatcagtcatgtcctcagagcatctgggttcttttagtagagaaatatggaccaagcatggtggctcatgcatgtaatctgtgcactttgggaggctgaggtgggagggttgcttgaggctaggagttcaagaccagcctgggcaacagggtgagacctcgtttctacaa

SEQ ID NO: 39925 - DNA, 247 bp, Homo sapiens
gtaagatttagtttgagctttcacttctcataacctcattcagctgcatgaggattacctgggagcgtctaagcccaccatccctggagattttgatcaaaaagtctgagataggcttcaggaatctgtattttgaaagaactttctgagtggttggataaacatccaggtttgaaaatcactgtcataggaattgaagagcattaaaaattgtgtgtagatgatactgagatgaaatctatgttta

SEQ ID NO: 39926 - DNA, 453 bp, Homo sapiens
tcaagatcttggacacaaaattatttcatattgtttacatgtaatactaatctaaagcttgctaagactcaagtaaaatgttagggtcagaaaagacaacataactagaagccctcttgttatgttgaataggaaagaaaaaaagtccactgggtatgaatcacataagttgcctctgtggcaggtgcctgcagcaattactttccaatgggtgcttaataaaaacagaagatggaaaactcaatacgtaaggtcaatactgataacagttcattagcacaagttgaggacaagcgaaggatgaatgtgccttgtcctccaagcagctgaagtgcacttccccaggcttctgtcttctcttctgagtcactgagtctctgtgctctttgacaccctataactggaggattatgattacttagtaggcttctgtgcttaacttgataaaacaat

SEQ ID NO: 39927 - DNA, 775 bp, Homo sapiens
cgttttgctacttactgtctcttgaggccaagtttttttccccctgattttttgccatctgtgccatatttttaaagagtttttctcctctaatcccttctttgatgccaggagaagcaataccaatggactggagatattccaaagcttaatgtacagggaccagctaaaaacctcaacaacattacttcacacacattctctctctttcgtttttgcaagtgggcatgtgataggggccacaagagaagataaataaagctcacaattcaacagggctggcaggctacctgctcttgaaacataaatcaggaggcccagggtcctggctgctgcctacagtcccagggagacatgattttcccagtcatttggaatggccaaacctacaagtcacaatttcaaggaagacaggttaaaacctcacattttccttgggctttgacctttggctaaagtcaggagctatgaactctgtgaagcttaagactcatctactttttaagaaaacttagaagactgctttaacccacacagttactcaatgggacaggaacagtgaggaacacaagcaagggccaagccaattagaaatcgattaattaattaaaaagaaaaaaacaactccagaagtcagcatcccatcctctagagatcctggcttactttgtgcctagagaacacttggtaactattgtccatttttaggtcttgttaaatcaaaaataaagcaatccatcttcagtaagtttgtagaaatatattcatctcatgc

SEQ ID NO: 39928 - DNA, 184 bp, Homo sapiens
aaaaaaaaaaaaaaaacaacaaaaccccaccccaaaccaatacattccaaaaaagcagacattgtacgggttctaatctctggctgcaagtaagcataactggaattaatttttaaaagcttaactgaacaagcatgtaagagagactcctaccacttgataattaaaaagaaaatgaaaacca

SEQ ID NO: 39929 - DNA, 562 bp, Homo sapiens
cagcctcctgtgttaatcaactaagacaggggtgtcccatcttttggcttccctgggccacactggaagaattgtcttgggtgacacaaaatacgctaaggatagctgatgagctcaaaacaaaacagctcataatgttttaagaaaacttacaaatgtgtgttgggccacattcaaagctgttgtgggctctgggttggacaagcttgagctaggagaaactatccaaagaattcctaacctttatcctgtctctagtagctttaactggtacagcttgttttctgaaagtcttaattttctgcttttattcaagaaggttacttcacaatatgaaaataagattatgaaatgatgctaaaacagttatacatagttcctttttcatgttggtaaatgttttcttttgaagtgggaaacaatcttatttttaaccctggtttcagtcaaaagtaactatcctagtgtgaaatgatatcgccaggataaactatcttttgtgattatttttaaagcagaaatgccagtttctcttacctcagtaaaagttgattttatagca

SEQ ID NO: 39930 - DNA, 586 bp, Homo sapiens
caaacatcaaattaagaccaataaaccactgagtgcatactctggagacattgtgcctttccaaatggcgtaatgagagtgtgagtacaactcacgctgtcactctcctgtcagaaaatgacagttgcctgtatcagttctactcccagagcactgactatcacagagtgaaaacttggatgtgacagcaccaactttctgccctccaagtaggagtctgtggggactgaaccagtccagaggaagaatcatcgctctagaaggagtgagtgtgtaaatttaaatcatcagcaaagcagaacctggttactgaaggcaggagagctggttccaaattatctccctcagttagtccccctccccaactctgacaaatgaattaatttacaggtccatttctgctaagttaaaatgcatctatcttctcctgggattttcttcttccatagaaatggagttttctctctccccagtgtcggctgaagctttcaacagaaaccaaaattctaaaataagaaatcctttaaaatatcagatccacatctccttcacctaagaaaaatatataaggccttttacatttaaa

SEQ ID NO: 39931 - DNA, 328 bp, Homo sapiens
gtgttctctgtggcacaaagcccagcttctacatccacaggtactgaagtatcagagactgatgctgagaagaccaactagtaatcagacttttgctatatcttcagggcttttataaaaggggttgcttattgcattattaaaatacagatatacagtagaaattaagcagtgaatccttacaatggaatgagtctcatactctatcagctgcatgctaggtagatttaaaacatgaaataaatgcttactattggcattccttctagttaatacttcctatgagcctgttaaaaatagctgaagcattaaaatattctaagatgtg

SEQ ID NO: 39932 - DNA, 903 bp, Homo sapiens
tctaaactacggacaggatgcatgggccagctagctgagaacttggaaactgcatagtagccaatatattggagaaggaaacaagaatttgaagtatgattgaactggggttgagtttcccatttattttccccccagttttgcctgaccttgactcacatgtagcccaaaacctggaagagtgcaccaggtaggggcagatagagctccaagagaatagaaagaactccttttctggtttgaggagcaggaaggtggctcctaaagatcagatgtgggaagttttcctgtttatgtgtttttttctccatcgtctcccactcaagctgccaggtagtattgcaatggaggcagtggcaatggtgatagcagcattagccaagtagatgcctaaaattcttagacagaaaaaacttctcctaccagaaaagccgtgagcccaagagcatggggaaattcctgttacttctgtctccaccctcacaccccaatccctctgccttctgttctcctgctgcttggccccagacacagatgcagttataagtacatagcagagctgggaaattaaagtcctagatttctggctgagagactggaaaaggaggccccaaagagccaaaaactgatgagggagattgtagagaggagagagcataaaagagtgatcccatacttttgtgtataaactcccagaatcacctccaaactgtgcagcatggatctgatcccaaacaaaacatcaaagaccttgagaactagtctacatatgaaacccatctgaagagtactgcaaatggctttgaaaactgaattgatattggtaccagaacccagagaaggtaggtggaactggcagcctggacctagcctggtcacttgtctgctaaaattaaaaaaaaa

SEQ ID NO: 39933 - DNA, 800 bp, Homo sapiens
tgggctcccaccgtgtgatgggtaaaggggaggcttgggtctggggtcacttgttgcatgccctttggcaagttaattgagacccaaggccttgtttcttccgctgtaaaatggaggtagtatccaccttgcagctaagccattttacataagacatctttaaagaacctggtacccaagaaggcattaatactaattttcttctcccattcccaaatgatcataattaattaattagttcaatgagtgtttaatgagaagtgctagttgcagggcactgttttaggttccatgagggcaacagaaaggtgttacatatggttctaacctctgtcacttcttacagtgtagacagaggtaagtctacagtccataccaccctgaatgtgactgatcttttctgatcttggaggctaagcaggttcgggcctggttagtacttggatgagagattggctgggaattccaggtgctataggttttaaatttattttttaaaaaatagaggtggccggccgggcacattggctcatgcctgtaatcccagcactttgggaagccaaggcgggtgaatcacgaagtcagatcgagaccatcctggctaacacggtgaaaccccatctctactaaaaatacaaaaaattagccgggcgtggtggcgggcgcctgtagtcccagctactcgggaggctgaggcaggagaatggcatgaacccgggaggcggagcttgcagtgagcagagatggcgccaccgcactccagcctgggcaacagagcgagacttcgtctcaaaaaaaaa

SEQ ID NO: 39934 - DNA, 135 bp, Homo sapiens
tggttgaaattactggtttcatttgaacgcagcaaagccaagtctttacaaaacattacctaatcagattttcactcattcttattagttgtcccgtcagaaagctgggtatataaaagactgtggcccactcac

SEQ ID NO: 39935 - DNA, 298 bp, Homo sapiens
agtgtttctctcctaaggccagtcagtaaagaccagagggggtgactgtttctttaaatgcaaaggcagcagcacaataattcaagaaacatgaaaaatcaagaaaacatgacaccaccagaagaacacaatcattttccaataaccaactccccaaaaatggagatttacaaattggtttataatgaattcagaacaattatgttaaggaagctcagcaaactaaaaggaacaccaatagactactctgtgaagtcaggcaaacaattcatgaacaaaactagaaattcaaaaaaga

SEQ ID NO: 39936 - DNA, 771 bp, Homo sapiens
actatgttgcttaggctagtctcaaactcctgggtgcaaatgatcctcctgcttcagcctcccagagtgctggaattacaggcatgagccactgtgcctggccctaacaattttttgaagagagcatttcattcactgttaaatttatttcttccctaaatctctatagaaaatgtgccactctatttctagcatgttagtaaacttggcgaggtttattctagactgcatcacggtggtggctttcttccatttggacattcagattggtcactgtctagttataagactctttccaccattggaaggataccataaattaaagtgaccttgctcagtagcaatccctttgactttgaagaaggctataccatataagtaatacactctgttagtcaatttgacacttgattttggttaattttgtctttaattactttttaaacttgaaacattcacacaccataaaactcattatttgaaagtgcacaattcagccaggtgtggtgactcacgcctgtattcccagtactttggggggccgaggtgggcggtcacctgaggtcaggagttcaagaccagcccagccaacacggtgaaaccccatctctactaaaatacaaaaattagctgggcttcgtggcagagacctgtaatcccagctactcgggaggccaaggcatgagaattgcttgaacccaggaggtggaggttgcattgaggccaagattgcgccattgcactccagcctgggcaacagagtaagactcc

SEQ ID NO: 39937 - DNA, 382 bp, Homo sapiens
tttagtgtgaaattttttatatggtgaggcattgactaacataatgggtattggctttaacaacagttttggaaaagatgtaaaagtcttcataactatatttcttccatcccttcagtagaactcaagccatagcattacatttcacaaaaacacttccataggaagttatgataatatgattatcaaggaatgatgctttcaggcatggtattcaggaacatatgataatatgattatcaaggaatgatgctttcaggcatggtattcaggaacatttctcctttcatcagcaaaaagtcatttatacctgtttttaaaaatcacttattgaaacttttttctcctttgagcacctttatttacatttgttcttccagta

SEQ ID NO: 39938 - DNA, 384 bp, Homo sapiens
cccaataaattttatgaagaaaaatgaagcagcttacagaaatagcagagtgaagggaagggctatgatagatggttagatgatagttgtcactgaccactgctctcaggtggtgccttttgagcagacacttggtatctgagaagaagagttggcagcatgatagcatgtgcaaaaggcctgaggcaggaatatgtttgtcctattggaggaacagcaataagcttggtgtggttgtagtcgggtaagcaaagattgtaagagatgaagtcatggaagtaaccagtggaacaaaatagggatgtccattcttatcattagtaatcaacattatgctggagagtctaaataattagactagaaaattgaagagttgttattaaa

SEQ ID NO: 39939 - DNA, 814 bp, Homo sapiens
ctacagccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtggtgcaaaagccgggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgccaaaactctgaaaaaaaagaagaaagaagactgcgaggggacactaaattcggggggtggggggaaaaaagggggtaataaaaggggccatgtgctctaatagggtttcgtgaacccaaggttttctttgtacacagtgttgtaaaattgggggatccccataggggggtcggatataaatgaaaagcggttacctgttttgggag

SEQ ID NO: 39940 - DNA, 811 bp, Homo sapiens
caggtatcttcgggtttggtagcgaggcctgggtggcggaaaagaagaggcgtgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtggtgcaaaagccgggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgccaaaactctgaaaaaaaagaagaaagaagactgcgaggggacactaaattcggggggtggggggaaaaaagggggtaataaaaggggccatgtgctctaatagggtttcgtgaacccaaggttttctttgtacacagtgttgtaaaattgggggatccccataggggggtcggatataaatgaaaagcggttacctgttttgggag

SEQ ID NO: 39941 - DNA, 731 bp, Homo sapiens
caggtatcttcgggtttggtagcgaggcctgggtggcggaaaagaagaggcgtgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggtgtgcaaaagccgggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgccaaaactctgaaaaaaaagaagaaagaagactgcgaggggacactaaattcggggggtggggggaaaaaagggggtaataaaaggggccatgtgctctaatagggtttcgtgaacccaaggttttctttgtacacagtgttgtaaaattgggggatccccataggggggtcggatataaatgaaaagcggttacctgttttgggag

SEQ ID NO: 39942 - DNA, 443 bp, Homo sapiens
tttttttttttgagatagagtcttgctctgtttcccaggctggagtgcagtggtgtaatctcagctcactgcagcttctgcctcctgggttcaagcaattctcctgcctcagcctcccaagtagctgggattacaggagcccactaccacacctggttaatttttttgtattttttgtagagacggggtttcaccatgttggctggtttcgaactcctgacctcaagtgacccgcctgcctcggccttccaaaatgctggaattacagggatgagccaccatgcccagccaacctttctattccttactcacttcatccataaattgggaataatagtaggacctctcatagggttgaggatcaattgaattaaagcactgaccaaagtgcaaggtacatatgaaatgctatcacagtgtcagctattttagctgttactgag

SEQ ID NO: 39943 - DNA, 357 bp, Homo sapiens
ggaatctttaatattgtcaaagtcttgacccaatagagacattcttgccccagactctcttgcttcagtgcctttgcctgttctggtcctaagtaccttgaatatccttctcttgatgccctgatataaaactctttattcctcaaagccaagttcaggttatcacctccaccacagacttttctttccctccccaaacttcattgcctcttctcatcactccctttgtaatttgtttatactggtaagagagcattcatcataattaggcctatctatgcctacctttcttgttaaattatgagctttgttctgccttggatatctctctggcttggatatctctctggcctttgc

SEQ ID NO: 39944 - DNA, 290 bp, Homo sapiens
tctcttcagtctgtcttcttgggaagttctggtgtgagcccaaccaagactgcatccctgtgatacaagtgtgagttacatcatagtctatttcttgctaaggccaaagtagaggaagtcgaggtaaatttgcaaatgctatttgagccagtggccatggaaataattatgctcacattcttcacaacagaaaacgcaagagcatgcctcacatgcctcacatcctgtgggcagctccactcacagttcaaactctctgcagcatctgttcaccagctgcacagcaaatc

SEQ ID NO: 39945 - DNA, 601 bp, Homo sapiens
tggggtctgtggtgatgggtccttaggaatagagagaaagagaaatggccttggaatttagtggcctgaagacatagtttaaaaattcatttccggacctcaacctacggcctttgacagaaagatgggtttgttgtctgctgtgaaataaaagccatctgaggcttgtgggagcatgatgagcaccagagtccggcttagaaatcacgctgatggcccagaaaactcagccaaccacagataccattgctgcttctagaagcccaggacactggcactgtgaggcaatgctggagattcgtcctatccctggtctcttgcaaacattttaaattgaaacctttaatagtcagcatgagagcactcggattcaattatattcatctctgaagatgtcctgatatcgcctacttgtttataaaaattaatcataaaatattgaactagtggagggtttgtatgttttctataaagtctaaaaaatgaattccatttggatccagtgaaaggtgaattaacgaattattccctcagtaggacaagaatgttgaagaaaaaaactgaatgatttttcttttgaacaattcttagccaatacaaa

SEQ ID NO: 39946 - DNA, 269 bp, Homo sapiens
ataacacaagggggaactgggcacttgcatattttttatgtctggaaatgaaagggctttcttcaaacctatgaaagcagctctagctgagatcagaaggctctggtagagactgttactagcagtgtgcctcccacccaccccaggtctgagggatagaccagaggaagaatttgcaggttcacaggaatggagaggcaggaatgcctgggtgtcggttgtgtagagaagaggctaatttttggtagtctaagcattccttgacttag

SEQ ID NO: 39947 - DNA, 696 bp, Homo sapiens
gaacctaatctgcctgatgctgtaatgatgaatacatgtcattgtaaatttgtctaaacccatagaatgtataacaccaagagtgaaccctaatgcaaactatggactctgggtgataatgatgtgttagtgtaggatcatcagttataacagaggtaccctctggtggtggcagggtgggggaatatgggaaatctgctcagtgttgctgtgaacctaaaactggtctaaaaaataaagaccgttttaaaaaagataaagtaataaaaaatatgctcacagctcagttgtgatactagtaatgcaatttttatgcaaaattatgcttttgaagaaatcagaattctcaattttttggtgattatttaaattttcctcatttttatatggtttcttttaaaatgtttcacttttttccctaatttatattagaatggcaatgtatgcttaacacttgtatttttataagtttatgagtttttaatgttctgaaatgttattttttacttcaaatgtgttgaacatttaacttgttaaaacattccaggctgggcacagtggctcacgcctgtagtcctagcactttgggaggctaaggcaggaggatcacttgagcccaggagtttgaggccagcctgggcaacatagtgagaccccatatgttttaaaaaaaaattctgaactaaaaaaaaaaaa

SEQ ID NO: 39948 - DNA, 460 bp, Homo sapiens
tccttccccaggccccatgccaccagcaagaacagcccagccaatgcagactgcacccctcggcctcggccgggaccgagcacactgccctgtgtgctctccctggcccctgaggcaggtggcctgacccctgtcttcagaggggaaagctgagtctcgggaaggccacacagccgaggagtgggggcagaaagaacccagctctgcgtcaggctgtgtcaagccgacatttagtgcctagcagcagccacggcctctgcagggcttcctggagcaggtgtgggctcttccagcacagagcatgggctgcaccagcttcggggtgcaccgcgtacaggttagggctgtggctgtggctgctggctgacaccaggagtaaacgtggacaccagaccagcgcagcctagacccagctgggtggcaggtgctgccagtgcgtctcgagggggcagcagggtca

SEQ ID NO: 39949 - DNA, 299 bp, Homo sapiens
tggaggttctgatcttggaggcatcctcttatgaaatccttaagtttcattcctcaccggctctgcccagatggcataattcaatgggaggcctaaagctgcactgatcaataaagtggccactagacacatatggctatttcaattaatgaaagctaaataaatgactgttcggtttttccattatactagccacacatatgtgttcgatagccccatgcagctcgttgctactgtactgaacagtgcagctatataatctttccattacctcagtggagtgtgataataaaaaaaaa

SEQ ID NO: 39950 - DNA, 779 bp, Homo sapiens
aacggagtcatggccatttgtttacgcattgtctatgctgtttcaccctgtagcaggagagttgggtaattgtgagagagaccacatgggcccataaagcctgaaatatttactatctggctttttacaaaaaaaaaactctcccacccctgatacaatccacatacattattttgtacaagtcctagtatgtaaacacttagctattgttttctatttagagttttgtattttgtgacttgcgaaaataaatgtgtgaattgtaaggcaatgtaaagctgaacaattgacaatgaaaactagattctggcatcaggttctcagaatatttgatttcaaggaaaagttacccagacatataaaatcattaagaacagagctactttgactggagccatggtgggggacctggaaaaatactatatcaaacatacacaattacgtaggtgctccttaaaacctaaagaaattaattgaaaacataaaatctaaagcctgaatgccagagggctttttctttgtatttcatgtaactttatactctcacctataagccacaagagcaaataatggcaatagcataaggtaagtaattactaatatcacacctttatacacttatttatataaccacaaaatttttttcttaaataatatcatttcttgaataagggaggtaaacagatggattctcaagtcactctgttttcatgaagctttcccccttacctgatattttatactggcatgcatttccaaaaggaatactttgcagaaaa

SEQ ID NO: 39951 - DNA, 300 bp, Homo sapiens
aggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctaggacatcatttacatttgagaaagctgtttttaacattattttaa

SEQ ID NO: 39952 - DNA, 3335 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaattttcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcaga

SEQ ID NO: 39953 - DNA, 1232 bp, Homo sapiens
caatttgttagcattttacagaagattaaactgaactcatatagtacaatttagacagcttttttaaagattcaagtgaagtttaaaataatggaaaattttatactaagatttgacatctgaaaaataaaattaatcatttgatactaaattcagaggtgctcaatccatgttggaacttaaacacatgttcatttgtatttttctattgaaaatcaactcactaaaacaaaaggattgtggcttttgacagcatactagtcctaacagtaaaggcattattttaaactttgccacttcctgtgctatattgtatgtatgaggtgaaactcgggaattattttgttttcttttgatcttcctctttatttaagggctttttgagggtgggggtgggggtggtcagacacttttgttagaaccatgtgaatggcattgttttttctgtattgcaaattagtatttctaccactctccccaggcctacacgcccagacacacacatacccaaccaaaaaaatctcccaagctcctctcttaggtatgtttccttattattcagtttttctgggaacaactgattgcataagaatatagaaccacctggaaggtgttaaatagaatctctaagaaattaggaataatttggatttgattagaatgaaagttttaaaaatcaagaatgccagtgagcgtttgtcatataaaactatctatagatactattggtactgatcctgggttgatttaataatcttagaaatgatttagagacaaagacatatttgaaaataatgagagtaaaatgtattaatatgaagattttggttctactgtttcagggttggtctaaggattttgagtactagttgaaaagatgttcaaaaggaagatgtactctttactgtgtttaggtaaactaagaaatgtgtctgcataaacaaaaaaagaaaatggttaattgtggaatggttaattgttaaattcccagtacttcccataggaatacaatgaaactctcattgtatcacactttactattcctctctcactttcccccctgggttcccaagtattgttttccctattgcaacatttaaaatagctatgttcctgaggaagacgagaattttaggaaagacttcaatagagcttttctagtgctacttccttccaggtaagtaaaaatttactaacgaaaatataatatttattaaaaaaaaaagcaattt

SEQ ID NO: 39954 - DNA, 940 bp, Homo sapiens
tcataggttcgcaggattatgtataggatatgggaggactacaaatcagcgagaaaaaggccagtagaataatggtaataaaagataagagagaacgcaaacagtttgaagctgaggattttccgtctttaaatcctgagtatgagagagaaccaaatcacaataagtctttagctgcaggtgtgtggggcctacacgcccagacacacacatacccaaccaaaaaaatctcccaagctcctctcttaggtatgtttccttattattcagtttttctgggaacaactgattgcataagaatatagaaccacctggaaggtgttaaatagaatctctaagaaattaggaataatttggatttgattagaatgaaagttttaaaaatcaagaatgccagtgagcgtttgtcatataaaactatctatagatactattggtactgatcctgggttgatttaataatcttagaaatgatttagagacaaagacatatttgaaaataatgagagtaaaatgtattaatatgaagattttggttctactgtttcagggttggtctaaggattttgagtactagttgaaaagatgttcaaaaggaagatgtactctttactgtgtttaggtaaactaagaaatgtgtctgcataaacaaaaaaagaaaatggttaattgtggaatggttaattgttaaattcccagtacttcccataggaatacaatgaaactctcattgtatcacactttactattcctctctcactttcccccctgggttcccaagtattgttttccctattgcaacatttaaaatagctatgttcctgaggaagacgagaattttaggaaagacttcaatagagcttttctagtgctacttccttccaggtaagtaaaaatttactaacgaaaatataatatttattaaaaaaaaaagcaattt

SEQ ID NO: 39955 - DNA, 440 bp, Homo sapiens
cgtgactaataatccatatgacacagagttttaacattctgttttgtgttccactgtcaaaacaccaaagaaccaaaaacaaaaggattctttctcctctcctccctgccatctcacaaacattttaccaggtgaaatccactcttataaaccctatgtatgtgtataaataattataaaatacattttattggagctgttactgaactctagaactctgtgtaacacagtttgaaaagctgctcttctgtgtattatagaaaagtttaaacaattctaggatgcatttataaaataatagacacctaatttagaatcatagttctgagtattatcagaccttcattgtttgtgggataagaaaattattttgttgactcattcagtaggggaaaaaacagggatagaactagacagtacagctaccttcccgtccgcag

SEQ ID NO: 39956 - DNA, 2954 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgca

SEQ ID NO: 39957 - DNA, 3455 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcaga

SEQ ID NO: 39958 - DNA, 2861 bp, Homo sapiens
gacgtagagggcggagcttctttgaccgcggcgtgagcggttgcttgggccagaaggttctctggtggaggcgctcttcctggtgtcccgcccagtaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgca

SEQ ID NO: 39959 - DNA, 3875 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaa

SEQ ID NO: 39960 - DNA, 2909 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgca

SEQ ID NO: 39961 - DNA, 2990 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggtgtccacatgcttctttcacggaatttctggtgactggggtcaaggatttcttatataaggggtgtggaaaaaaagggggaaatcggcagcatgaaggcagagaaaaagggaaggaggtggtggtgaacaaattgttttttaagatcca

SEQ ID NO: 39962 - DNA, 1928 bp, Homo sapiens
taagaatggaactggtccaagtgtttataaaggtttagtccctaaacctgctgctccacctacaaaacctacacaatggaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgca

SEQ ID NO: 39963 - DNA, 2609 bp, Homo sapiens
cactaattcacatgatcttatttaatgtggagaacttaatttattctaaactttccagctgtgaaactgatgcttttaaaagtttttgtaagggaagaaagaaagacttcactgcaatgtctgtttgattacacacacacattgattaaattataggaataataggtatttttggcaactgcagtagtcttgagaaaagtctgcctttagcaattattcgtagtatttatcttcagaaatcaggattgagttggttggtctgcattcatataatgctttgaatgtagataaatggtcaataaatacatgaatgaattgatattgtgaaatagaattctcagtcataactgaagtatttagaaataaaaggaatgtaatttcttgcttattggtaataactttgtaagtggagtaaaaagaatgaaaaaattgaaattttaattctcttcaaatggggaagggaaaatagaaatgtattttatattctaaatcttaagagtcattaggttgatgtttgcaattttttatagttaatgcaaggcatgttaaaatataatttgtcttggttttaacattctgagccactgtgtagcagaatttatctgtattacttgacattgcccaattcttcctatattctgtgggataatgttttagctttacttgttcaattggaatatagtttgtacttttttagtttagttattttacccaggaggcagctgttagttaaaaaaaaaaaaaaatttggaatatactgttcttttggtggttttattctatactaaaacttgaaattgtgagtgactcttggtcatgctttatttatgcagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcaga

SEQ ID NO: 39964 - DNA, 1936 bp, Homo sapiens
cagttcgacggagactctcatactcaggattttccgtctttaaatcctgagtatgagagagaaccaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcaga

SEQ ID NO: 39965 - DNA, 1890 bp, Homo sapiens
  misc_feature (26)..(27): n is a, c, g, or t
  misc_feature (29)..(29): n is a, c, g, or t
  misc_feature (32)..(32): n is a, c, g, or t
  misc_feature (36)..(36): n is a, c, g, or t
cctcgtcagtgatactgtggcagtgnncnganttcncggctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcaga

SEQ ID NO: 39966 - DNA, 2053 bp, Homo sapiens
  misc_feature (12)..(12): n is a, c, g, or t
ttttttaaaccngccgccactcagctcagtcacttagagatccctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaa

SEQ ID NO: 39967 - DNA, 2417 bp, Homo sapiens
cgtgactaataatccatatgacacagagttttaacattctgttttgtgttccactgtcaaaacaccaaagaaccaaaaacaaaaggattctttctcctctcctccctgccatctcacaaacattttaccaggtgaaatccactcttataaaccctatgtatgtgtataaataattataaaatacattttattggagctgttactgaactctagaactctgtgtaacacagtttgaaaagctgctcttctgtgtattatagaaaagtttaaacaattctaggatgcatttataaaataatagacacctaatttagaatcatagttctgagtattatcagaccttcattgtttgtgggataagaaaattattttgttgactcattcagtaggggaaaaaacagggatagaactagacagtaacatagacattataatcaattttattttgtgagtaaaggtaaaataggaagctgtggtagtagtgaattttatgttgacattgattccttggctacatatttatcagtatttctgaatttcctcttagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaa

SEQ ID NO: 39968 - DNA, 2841 bp, Homo sapiens
cactaattcacatgatcttatttaatgtggagaacttaatttattctaaactttccagctgtgaaactgatgcttttaaaagtttttgtaagggaagaaagaaagacttcactgcaatgtctgtttgattacacacacacattgattaaattataggaataataggtatttttggcaactgcagtagtcttgagaaaagtctgcctttagcaattattcgtagtatttatcttcagaaatcaggattgagttggttggtctgcattcatataatgctttgaatgtagataaatggtcaataaatacatgaatgaattgatattgtgaaatagaattctcagtcataactgaagtatttagaaataaaaggaatgtaatttcttgcttattggtaataactttgtaagtggagtaaaaagaatgaaaaaattgaaattttaattctcttcaaatggggaagggaaaatagaaatgtattttatattctaaatcttaagagtcattaggttgatgtttgcaattttttatagttaatgcaaggcatgttaaaatataatttgtcttggttttaacattctgagccactgtgtagcagaatttatctgtattacttgacattgcccaattcttcctatattctgtgggataatgttttagctttacttgttcaattggaatatagtttgtacttttttagtttagttattttacccaggaggcagctgttagttaaaaaaaaaaaaaaatttggaatatactgttcttttggtggttttattctatactaaaacttgaaattgtgagtgactcttggtcatgctttatttatgcagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaa

SEQ ID NO: 39969 - DNA, 424 bp, Homo sapiens
aagctttacattaaacttaatttcctctccttttcagattgttaaaggaaatgggctggcaggaagacagtgaaaatgatgaaacatgtgctcccttaactgaggatgaaatgagagaattccaagttattagtgaacaggtaagagaacctgaatcatacaacttcacttttaaactgcccttatttagaacaatataattatatgtaagcatggagtgggggagatttaggaatttatcacgataggtcagaattgcttttaaaaaaaaaaagagggaggacaggcttttgctatggtgtccagctggcctctagaactcctgggtgccaggtgatcctccaaccttagcctctggagtaactgggactacaggcaggaaccactgcacctggttgaattgactttatagaagtctgcaata

SEQ ID NO: 39970 - DNA, 3515 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcaga

SEQ ID NO: 39971 - DNA, 3330 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgatttcagtctgtgagatactaatttgataatattaccacg

SEQ ID NO: 39972 - DNA, 1952 bp, Homo sapiens
gtgaagtaggtagcgttacttatctacatcagcttcacatattatcgtcataggatacataatacaatagtcatcgtactcgtggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgca

SEQ ID NO: 39973 - DNA, 3687 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaa

SEQ ID NO: 39974 - DNA, 2435 bp, Homo sapiens
tgaaagcaagtttattaagaaagtaaaggaataagagaatggctactccataggcagagtagcctgttttttaaccctgacttttttcttagttatggataaggaaacttaaacacactcttgttttctctgaccagcaattagtatagatagtaactagtttaatggttagcaaagtaagctgagagtaaggtttatgagtaattcatgtttaatacaggctgaatgtcctttatctgaaatgcttgggaccagaagtgttttggattttggatttttttcagattttacgtttattatttcagcatcctgtttctgaaaatccaaaatccaagtgcttcaatgagtaggcagagcgtgacactggcactcaaaaagtttcagattttgtagcttttcagattagggttattcaacctgtagctaagagttggtcatatttgattcatcagttacaacatgtatgattctgagattggttttaaatgatttatttttaaaatgtgaaatgtttattccaactttcttccagccgtctttaaatcctgagtatgagagagaaccaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcaga

SEQ ID NO: 39975 - DNA, 2483 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtgggaatatcctccgaatcctaaatctagagctccaaggatgctggtcattaagaaaggtaatacaaaagacttacagctatctggattcccagtagtaggaaatcttccgtcacagccagttaagaatggaactggtccaagtgtttataaaggtttagtccctaaacctgctgctccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacaggtaagagaacctgaatcat

SEQ ID NO: 39976 - DNA, 2430 bp, Homo sapiens
cgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttggacttgccatgaggtgttgaagccttgtttcactgagttggagagactggacctaaatggcgcagcatgactttgctccagcctggcttaatttccctactccaccatcatcaacaaagtcgtcattgaattttgagaagcattctgaaaactttgcatggacagagaatcgttatgatgtgaaccgtcgacgacacaactcttcagatggctttgattctgctattggacgtcctaatggaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttccgtctttaaatcctgagtatgagagagaaccaaatcacaataagtctttagctgcaggtgtgtggggcctacacgcccagacacacacatacccaaccaaaaaaatctcccaagctcctctcttaggtatgtttccttattattcagtttttctgggaacaactgattgcataagaatatagaaccacctggaaggtgttaaatagaatctctaagaaattaggaataatttggatttgattagaatgaaagttttaaaaatcaagaatgccagtgagcgtttgtcatataaaactatctatagatactattggtactgatcctgggttgatttaataatcttagaaatgatttagagacaaagacatatttgaaaataatgagagtaaaatgtattaatatgaagattttggttctactgtttcagggttggtctaaggattttgagtactagttgaaaagatgttcaaaaggaagatgtactctttactgtgtttaggtaaactaagaaatgtgtctgcataaacaaaaaaagaaaatggttaattgtggaatggttaattgttaaattcccagtacttcccataggaatacaatgaaactctcattgtatcacactttactattcctctctcactttcccccctgggttcccaagtattgttttccctattgcaacatttaaaatagctatgttcctgaggaagacgagaattttaggaaagacttcaatagagcttttctagtgctacttccttccaggtaagtaaaaatttactaacgaaaatataatatttattaaaaaaaaaagcaattt

SEQ ID NO: 39977 - DNA, 1965 bp, Homo sapiens
tttttgcttcaggtttctcttttaataaacaaaaccatccaaggtacagttccaaagtacaaaatcaaccaggtctgaactgattggtgataagagcacacagatcagtccttccttaaggaaacagtttcctccctgatgccctctttggtcactatgcagatccggagtgcgtccccagtgtacacatctctctcagccgcagaaatgaagacatctttcaccagccgcatgaagatgaaagccgtgctggctcagagaaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacagattgttaaaggaaatgggctggcaggaagacagtgaaaatgatgaaacatgtgctcccttaactgaggatgaaatgagagaattccaagttattagtgaacagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgaggttttatgtcagatctaatcttaa

SEQ ID NO: 39978 - DNA, 852 bp, Homo sapiens
ccgcacacagtatacttttggacaatctgcagctataaaaatatacacatacaaaagtacagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaacttattcattcattcattcacttatggagttgttactgattttgcggaggtcaggttcataccaatggacactaatacaatcagtgttcccaaggctgtgcaggggtggggggacatgctgtcaggatggtctgagcatctgggtgagaaccagagaaacaggacttcttccttctgtaccatgagctgtgtccctttactatgcaagcacatgaccccagagacagctggttcactggcagatccccatgatggacttactaagggaaaggtgagatgaacactgcccccaaggagggggtgaaatatgatctaacttatgcaagagcctataattagtcccagtctcgactctacatttgtttgtgcagcattcattcagcaaagacttttggggtttgtgcaaggcacagttttaagcacataatgtaattctaaaagatgaataaactagagaggttc

SEQ ID NO: 39979 - DNA, 393 bp, Homo sapiens
ccgcacacagtatacttttggacaatctgcagctataaaaatatacacatacaaaagtacagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaactt

SEQ ID NO: 39980 - DNA, 780 bp, Homo sapiens
acagtgaatctgacaactgagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtgg

SEQ ID NO: 39981 - DNA, 2222 bp, Homo sapiens
ggacgttctggactctcgggcagagcttgtgagagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaatcataatcataatgcggcccccttccccagagcttacctcgaatgtgaaatccctacttcttataatgcagagttaaggagctgagcccccatgattttgtagctgtacttttgtatgtgtatatttttatagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaacttattcattcattcattcacttatggagttgttactgattttgcggaggtcaggttcataccaatggacactaatacaatcagtgttcccaaggctgtgcaggggtggggggacatgctgtcaggatggtctgagcatctgggtgagaaccagagaaacaggacttcttccttctgtaccatgagctgtgtccctttactatgcaagcacatgaccccagagacagctggttcactggcagatccccatgatggacttactaagggaaaggtgagatgaacactgcccccaaggagggggtgaaatatgatctaacttatgcaagagcctataattagtcccagtctcgactctacatttgtttgtgcagcattcattcagcaaagacttttggggtttgtgcaaggcacagttttaagcacataatgtaattctaaaagatgaataaactagagaggttc

SEQ ID NO: 39982 - DNA, 2104 bp, Homo sapiens
agagaaccacatactatgtaacctcctttttctgttctgtcccagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaatcataatcataatgcggcccccttccccagagcttacctcgaatgtgaaatccctacttcttataatgcagagttaaggagctgagcccccatgattttgtagctgtacttttgtatgtgtatatttttatagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaacttattcattcattcattcacttatggagttgttactgattttgcggaggtcaggttcataccaatggacactaatacaatcagtgttcccaaggctgtgcaggggtggggggacatgctgtcaggatggtctgagcatctgggtgagaaccagagaaacaggacttcttccttctgtaccatgagctgtgtccctttactatgcaagcacatgaccccagagacagctggttcactggcagatccccatgatggacttactaagggaaaggtgagatgaacactgcccccaaggagggggtgaaatatgatctaacttatgcaagagcctataattagtcccagtctcgactctacatttgtttgtgcagcattcattcagcaaagacttttggggtttgtgcaaggcacagttttaagcacataatgtaattctaaaagatgaataaactagagaggttc

SEQ ID NO: 39983 - DNA, 2168 bp, Homo sapiens
ggacgttctggactctcgggcagagcttgtgagagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaatcataatcataatgcggcccccttccccagagcttacctcgaatgtgaaatccctacttcttataatgcagagttaaggagctgagcccccatgattttgtagctgtacttttgtatgtgtatatttttatagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaacttattcattcattcattcacttatggagttgttactgattttgcggaggtcaggttcataccaatggacactaatacaatcagtgttcccaaggctgtgcaggggtggggggacatgctgtcaggatggtctgagcatctgggtgagaaccagagaaacaggacttcttccttctgtaccatgagctgtgtccctttactatgcaagcacatgaccccagagacagctggttcactggcagatccccatgatggacttactaagggaaaggtgagatgaacactgcccccaaggagggggtgaaatatgatctaacttatgcaagagcctataattagtcccagtctcgactctacatttgtttgtgcagcattcattcagcaaagacttttggggtttgtgcaaggcacagttttaagcacataatgtaattctaaaagatgaataaactagagaggttc

SEQ ID NO: 39984 - DNA, 2097 bp, Homo sapiens
acagtgaatctgacaactgagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggcccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatcaaacacagaatcataatcataatgcggcccccttccccagagcttacctcgaatgtgaaatccctacttcttataatgcagagttaaggagctgagcccccatgattttgtagctgtacttttgtatgtgtatatttttatagctgcagattgtccacacagtatacttttggaagtttgggtggatgactctgaattcttgcacacctttcctaaaaatttctcccaagagagacttgtttgggccttttgtggtgtcagtggaatggataggtaacttgggtgggcaacttggggagctgaccattctcttttggtaaatgttgacggctcaagaggatgaatatgaagctttccaagataagcagattaaaaggaacatgtgttaccgaggtaggtcactgtcatttttgttttaagagttggggggagtatctatagtaaacttgaataaaggggacaaagctagaacttattcattcattcattcacttatggagttgttactgattttgcggaggtcaggttcataccaatggacactaatacaatcagtgttcccaaggctgtgcaggggtggggggacatgctgtcaggatggtctgagcatctgggtgagaaccagagaaacaggacttcttccttctgtaccatgagctgtgtccctttactatgcaagcacatgaccccagagacagctggttcactggcagatccccatgatggacttactaagggaaaggtgagatgaacactgcccccaaggagggggtgaaatatgatctaacttatgcaagagcctataattagtcccagtctcgactctacatttgtttgtgcagcattcattcagcaaagacttttggggtttgtgcaaggcacagttttaagcacataatgtaattctaaaagatgaataaactagagaggttc

SEQ ID NO: 39985 - DNA, 1290 bp, Homo sapiens
ggacgttctggactctcgggcagagcttgtgagagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaacaccagctggccttgtccaagggacagagccttctattctgagaatcccaggggccctcagaccctgcctgatgctatatgcagaggcccagggaccaggtgtgtttcctctcaccaagaagaaagtacacactgatgagaaactgagaaccaagacaggcatccctgggtggcctttcctgctgacactccacgagctgacccagcagaattctctgtgtaggaagcatcggactttgtccattgaatatgtagcggctgccagagatcacacatcaatgcaaattccagagcctgtctgctatagctcagtgactgtgttgtgattcatagtacattaaaaagagagagagagagaaagaatcccacagggcactattaaaatacttctctccttccctgactcatgacactcttcctgacagcagaatgactgtgtgaccttgaacttcacatttcccacattggcccttggattgttcggattaaccccttccactcctcactggctggttcactgtgttctgactagtccataaaaataaagatggaaggagatca

SEQ ID NO: 39986 - DNA, 915 bp, Homo sapiens
acagtgaatctgacaactgagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatggtgagaaagaagcaagttgaaggcggtttctatctgcatgttaatttgtgtagatgtactttatcatcaatatagtttctttgttaaaaaaa

SEQ ID NO: 39987 - DNA, 1446 bp, Homo sapiens
acagtgaatctgacaactgagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcccgaagggaggcttcacaccagattaagtggcagcacccgacacttctgcattggcgggagtcccccactactgatgatggtgcaagaacgactcgggtgtccgaaagcttagagggagcacccgaaacatatctgatgacgcgacctcccgtgagatgacttcacccccgcggaagtgggaagcgccccccctgtgagctttgccctgtggcatctccccgaacagacacacatggacccgcatcgtccccaacatgaacttcaaaacaa

SEQ ID NO: 39988 - DNA, 1256 bp, Homo sapiens
acagtgaatctgacaactgagacggctgcagaccatggggcagggagcatatggagcacggatatgccagacagagggatgattcatatcccaggcaggatggagcagggcagtgtgctatttcatcgtgctactcagaacttatgaattgtttatttctggaatttcccatttaatatttttggactgtggttgatcgagggtaaatgaaattgcagaaagcaaaaatacagataagggggactgcttgctgtacaaagatagagacaagaggaaggagctgtcctcaagggccttttgtgtgaagacatctggcacacagatacgctgcatgcaggtggcttgagagaacatgcatccaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcaggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcccgaagggaggcttcacaccagattaagtggcagcacccgacacttctgcattggcgggagtcccccactactgatgatggtgcaagaacgactcgggtgtccgaaagcttagagggagcacccgaaacatatctgatgacgcgacctcccgtgagatgacttcacccccgcggaagtgggaagcgccccccctgtgagctttgccctgtggcatctccccgaacagacacacatggacccgcatcgtccccaacatgaacttcaaaacaa

SEQ ID NO: 39989 - DNA, 175 bp, Homo sapiens
taaggaaactgcactctgagttgcaaagaacttttgccctgagaatcgtctgtgaaccgtgtctgcttatgcctcagtgttttattctgttctctgtcttcttcttctccaatgccttagctataacctgggcagtggtgtggcatccatcatggtgaatggctccttcaacgat

SEQ ID NO: 39990 - DNA, 415 bp, Homo sapiens
aataaaagacaggttgtatgtgctatttccaaataaggggaatattggatggtgtagtagaactgtggatgatttgcaacagtttcggtcaagtatcacctaagataatttaatagcaaatatttatagattacaatgaaaacaaccttttgaattggagctgcatgaccactccattttcttattttttaacatatggtaaaggttaagatggcattttctctttatattttgggtttttgttacctgtctcattcacacattttttaaggcagtatgagaagaaaagggaacataaagaattgaaacatatttcttctccctttacaaaaagtgcctccattttgtttcttgacctttaaaataacaaagatccgtaatttcaagcactggcttgaataactctcaacattta

SEQ ID NO: 39991 - DNA, 343 bp, Homo sapiens
gacatgtgcattgcaggattgttttaatagcaaaaaactgggaaatacttaaatatccatttttaaaaatggggtaaataaattatggcacatccctacaatagaattccaagttgccgctaaaatgaggtacaaccatatttcttgatctagacaaaagtctgtaatatattaagtgtctttaaaagttataaaataataggtttgctatgtccccattttttgtaaaaacaaagagaaacaaaaactctgtgtgtgtgtgtgtgtgtgtgtgtgtgtgtgtgtgtgtgtgaatgtacaggtaaaaaaaaagtccagaccatatgttttctctcaatagtgg

SEQ ID NO: 39992 - DNA, 1082 bp, Homo sapiens
aaaagatctggtatgatgaacttaattgtaaagtcctggaagactgttgtgttggctgctaggcttggctgtatttgatggagcctccaaataagtgatttaagcaaggtagacatttatttttctttcacacagaagtgaaccaatatggcagttctgctatacgaaatctgacctctcttgtttctccagcattcctggggtgttgccctcatatgcctggcccaagatgattcactcccacttttacatctagccagcaagcagggggaaaatgcctgatctggaagttgtgtctgttatttccagtcacttcccattgttcagaatttagtcacctggtcatatcctagctataaatttgggttggaaatgtgtttcttctgggcagttgtatgcccagctaaaaatctattatatagcaggagggagaaattaatattgggggaacaaccagacatctctgccacaatcaagactttgttttgtatttctttgagtgctacacagtacttaacactgtggcttatccctgaagtctgaataaattcttctcattagttctttgtatgaaagactgaaggtctttggatcttggatttacctgctgctggggcaataagaaccctaagagattattcacagaagtgtttcctttttaatccaggcaataacaggaaagaaaagtattagtatacattgattacaatgatagcatgacatttaacctatatttataacttgttttccaatagtctgcaaaaacttaaaaagtaggaagaagccagccacagtggctatcatccacattcacagtggcctatcatcccagcattctgggaggctgaggtgagaggatcactagagcccaggagtttgagactaatgtgggccacataatgagacccccatctctacaaaaaaattaaaaaattagccaggcatggtggcacacacctgtactgccagctactctggtggctgaggtgggaggattgcttgaacccaggagtttgaggctgcagtaagctagggttgcaccactgcattccagcctgtgtgccagagccaaatactgtttc

SEQ ID NO: 39993 - DNA, 468 bp, Homo sapiens
ttttcaaaaatacaatataccagagttggattacttaataacatacattaaccagaggaatacactatctttatcatctggcttgttttattaatagctgctaattttagttacgtgttaaattttattgcagattaattactaagaaatagcatattgatctatcttttatccatttaaattgttagatatacataattcaaattcgcccttggttacttttagtaatcttataggatgtattttataatctagttctctgtgaagtggcttttaaaacttttgtttgaattttaaaatgaggcgggcggatcacaaggtcaggagatcgagaccatcctggctaacacagtgaaaccccgtctctactaaaaatacaaaaaattagccaggcgtggtggcaggtgcctgtagtcccagcactttgggaggccgaggcaggtggatcacgaggtcaggagatcgaga

SEQ ID NO: 39994 - DNA, 245 bp, Homo sapiens
aaatgttctatggatgagtgaagaaccaattttcttcagaccccaccatttgcatctggtcagctttagacctaaagaacaattcaattcaacacagtataatgccgtatatatttattgacaatctaccttgtgtcagacatgtgcaaagtcttgggaatacaatgacatgacaagagatagcacctgccctgcagaagcggatgagatacagtgtgataaatgttctcagaggtttaagggca

SEQ ID NO: 39995 - DNA, 374 bp, Homo sapiens
tctttgagggaattggcctttctccactatcagtccatgtgtggttccagggataggcatgtggctcgggccttagacagagtcaccatgattaattaagaggtggacacttgaccaagctgggccaatctggctcagccctggaacgtttgctggaattattctttttccacaagcactgctaagctgaaacaatgtaaattagatctactagtagccttatttgtcaccttgaagacagaagtggatttaaaatgagcgagcacagaggaaccaagaaatggagagagacagatccttcatggcgtgatttgaacatctggatctgtccatgcccgaagccaaatactcctgactttcaaattaagtgagcc

SEQ ID NO: 39996 - DNA, 418 bp, Homo sapiens
acaaagtactttatataattaaaagtgtgcatcatcatttatagtgattactgtgctgaaaataatgtgttaattttaaattttgaaacaattctaaacaaaagttacaagtacagtatataacttttttaaagatatttgagacggatgcttctcttttgtccctctaaataccttagtatatttctcttctttaaggatattctcctatatagccataatataccatcaatatcagaaagtaacaaatgtatgttatacacacacagacacacacatttacatatatatgtctgtgtgtgtgtgtgtgtgtgtgtgtgtattgaaaaatataagtgtacacttcaatctccaatttcagttcatcattagaggggccctaattttcatccctcctatatttgtattgtctttctga

SEQ ID NO: 39997 - DNA, 745 bp, Homo sapiens
tgacatcaaaaaatgtacattcagtgaatgcagaacaaatgaagggaaaagtgcctttaaaattacctcactgtgggctggaagaagcgaaaatctctgcccagcttccgtatcatagagagccctattcatcgctgcccaggccttcccaggaaaatcattttttctgggctgatgttgtattctgccatggcgcatatgttcttacagaaattttattgcttttgtcttgggtgctacaaaattcacagcaagccattttggttacatatctactggttgcaaggcaggaaatattggtgaaatgctagcaaagtcacaatttctactctgaacatgatttgcagtgttcatcagtatttttctgaaccctgctttaccattttctatattgccaagttgaatcatgtgggctgatgcagggaagctctgaagcagtgaataaaggtgtttcgggccctgtaagtgtttccatggtttctggtgtctgccagcagtagtgaacaaagctgcagcttctttgaaccgcgactactggaagtggcctttgctctcagggaacatggtgatggagggttgcatcagctccacccatggccaacagcccttgttgagtgacgggagtcggaatgtgctaccccgttgtgggaatcaggcaattcgctttattttcttgcattaagacttcattttcccagtattgaaatagccatacttttcctttacatacctctatactttccag

SEQ ID NO: 39998 - DNA, 671 bp, Homo sapiens
gggtgggtaggagggaaggaccatcgggttggggtgaggctaggcgtttctgacctctcactctccttgggcgggtcttgctatgggttaagtaggtgacattcccaggtcactggtgttgtgtaccaaggaggattatggttgcttctgctgagtcatgcaggttgtcagggaagtgggggaaagctggcagtcacaggcctcacccagctcccctgcaaaacgaagggccggtctcactcccaccatgcccaccacaacagcccccagaccatttccaggtggagagcgataggggcttgaaaacctgccccagactatccgcctcccagctgccaaagaagagggtttagttcgtgccgccgctgtggagtctgcacactggatttgcaccctcccctgagttctggccaggaggcttcttaccctgttcaaattgttacacagttcagctagagatttgcttctccctgtggagttttagcccttgctcctacccattggatccccgtggtgccagacaggaatgggctgctgggggacccagtgagctcccagggccttgctgctgcttcctctacgcctgtattttgcttggctttccaaattgactcagcgccagataaagttggaaacttctcctgcaaacagaccttcagcttcccccgtga

SEQ ID NO: 39999 - DNA, 424 bp, Homo sapiens
aagatgatctcccactcagaattggctttatttttgctactttttagcactctgactttgggtagtcttcagcctcttggaccctttgttttctcttcagaaaaatgaagagtctaaggtgctatttctagcaccagaaaaattgtacactcttaaaaaatagctaaaggaaaaatatgaataaggtctgtgggttgtaccaatgtcaatttcctggttttgtattatagttatgtaaaatgttgccatttgagaacactggataaagggtacatgaggctttctctgtactacttttgcaacttgctgtgaatctataattagcactttgggaggtaaaggagggagaatcacttgagcccaggagtttgagaccagcctgggcaacatggcaagaccctgtctctatataataaagtaattt

SEQ ID NO: 40000 - DNA, 417 bp, Homo sapiens
tgttaagctttatcagtagaggacactggagagacactgcaggaggaaagagttatgctgcctggttccagtatgttcattcaatagactcctgcaagaacacggcttctcccacacccagctcctacagaaccggtagcttctgcagtgtctggttcctccagcacggagttcttcagcaccggccttatgcagtacatggcagctagatgcagccagatgccagcaacttcccccagcaccttgctaaggcagttttgtactggagtgcattcagagagacacccctccatgaggctccctaaaagtaatttccagaaagttccagagagtgaagtaccaacaggttttgctggcacagcaccacagataatttcctgccattcaataagccacgctatgtcctccaacaaggtc

SEQ ID NO: 40001 - DNA, 330 bp, Homo sapiens
gtggttcaacatatgaaaatcaatcagtgtgatataccacgttaaggacaaaaaccatacgatcatctctgcacaaaaagcgtctgacaaaagtcattacccttttgtgataaaaacacagtacaaactaggtatagaaggagattacctcaacataagaaccgtatgtgaaaagcccacagctaacatcatactcaatggtgaaagactgaaagcttttcctctaagctcatgaagaagacaaggaggcttggttttgtggcttctatttaacatggtaatggaagttctagccaaaggaagtaagcaaaaaaaaaaaaaatcgaaatt

SEQ ID NO: 40002 - DNA, 387 bp, Homo sapiens
agctactcaggaggctgaggtcagagaatcacttgagcccaggaggttgaggctgcagtgagctgtgattgcaccactgcacttcaccctgggcgacagggcaagaccatgtctgtctgtctgtctgtctgcctgcctgtctgtctgtctctctctctctctctctctctctctccccccacaacacacaatgttattatatattttatttctagacagtgtcctatgatgagtatttcagcaaaaaaatctgttattgtgctgggcacagtggcccattcctgtagtcccaggtactcaagagactgaggcaagaggatctcttgagcccaggattttgaggccagcctgggcacatcgtgagaccctatctcaaaaaaaaaaaaa

SEQ ID NO: 40003 - DNA, 880 bp, Homo sapiens
ccagggatctgagcagctccttctagcatccttcatccttcaggtaccagccatccagacagtgcttgagctgcagaaactgagaccagacctctggcctggccctccccaggggcctcctttcctatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcc

SEQ ID NO: 40004 - DNA, 928 bp, Homo sapiens
ccagggatctgagcagctccttctagcatccttcatccttcaggtaccagccatccagacagtgcttgagctgcagaaactgagaccagacctctggcctggccctccccaggggcctcctttcctatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagccaaaaaaaaaaaaatcggggatatagagggggggaaaagaggttgatgg

SEQ ID NO: 40005 - DNA, 4459 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattaggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaaccttaaaaaaaa

SEQ ID NO: 40006 - DNA, 4386 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattaggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgcccctaccgcggtcccggctca

SEQ ID NO: 40007 - DNA, 870 bp, Homo sapiens
ctgcccagattatccctggcaggtggaaatcaggatagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaaccttaaaaaaaa

SEQ ID NO: 40008 - DNA, 463 bp, Homo sapiens
tgtaacaacggtaccctcttccaacaccaaaagaaatgctctcacatgaaagtgggagacacagtaagtagctggccagtagatagtctgaataaatacctggatgggtcagaaattagctgagctcactgaagctggatttctttcaagaattttaaaagcaattttcaaagattttctagtaaatgcttttggcaaagctgatttccgtgaagccttgtttcacctcgtgcattttggtggatggagggagataattagtattttcttttccaggcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtg

SEQ ID NO: 40009 - DNA, 3902 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgcatgaaaaaagtctgtttcactgatatgaaatgttaatgcactatttaatttttttctctttgttgcttcaaaatgaggttggtttaagataataataggacatctgcagataagtcatcctctacatgaaggtgacagactgttggcagtttcaaaataatcaagaagagaaatatccttagcaaagagatgactttggggatcatttgaggaatactaactctgttgcattaatgcttcaaaaaatcatcaaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattaggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagtttatgctgtaatagttatgctgtatagttatgctgtggtccgc

SEQ ID NO: 40010 - DNA, 519 bp, Homo sapiens
tcctaatcattgagaaacagaatgggatcatcaatagttaattaattagtctcatcatcagggttgagatgaatgttgagcaattaatcatcattacaagtattccatgtaccatgatttatttaactaatttcctattaaggtttaatatcaaattttcatgataataaataatgttgttaggtatatctttgttccatataattttgtatacttgtgcaaaggtttttgtagactagattacttgagtaacattcctagatcaaaggaagttaacagacactgtcaaactaaagttataatttgaagaatatgtatatacccccatacatattcctaccaatagagtgtaggtttccctgactccccatcaggcctctttacctcttatcaatctaccagggctgctacctacagggatctgctaagggggcagactgtgcactatagtagcttcatctgatttctaagaggaggcgtaagccttggccatgaatttttaagtctcaattatagaac

SEQ ID NO: 40011 - DNA, 442 bp, Homo sapiens
ctttaggactccaaagacgctgtcacttacatggtattcagggaggacacagaggatctgtgagcagcctgcagccaagctttgagatcatattgagatttttttgtaatatatgaggagtgttctggctccttttattactttcttcatagcaaaaattgggggtccaagttgtcgttaaattgaaactctctcacttaccctgaaaaagatttgactgtgagcataacattgttacttcattcaagacatggaagcaaaagggttaattagtgctgctcacaaaatagttctactttttcttcttccaattatatgattggataacccttccctcccttgaagtcagggttgccatgtggcttactttggtcaataaaatatgattgagagcaatactgtggtacatccatacagtggaatattatccagtgataaaaaa

SEQ ID NO: 40012 - DNA, 336 bp, Homo sapiens
cagggcgggtgaggaaagctatcagtagttgtcatctccagcatccacacataaggaactaatgtaacatgtcatattcttcaccttgaaagttccaccaaatagctaggcttgtatcaatttgcaaggtgctagaaaattattgaatgctctgtgcatatttagagatattgaataagacagcctgaaaaatttttactattagataatgtatgtaattcttatttgggaaaatttggtttttggggaggttaaaactgggaattaataaggctaagtaattttgctttgactcactgttcactctcaatacatactgaagttctccggggaagg

SEQ ID NO: 40013 - DNA, 3004 bp, Homo sapiens
ctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgc

SEQ ID NO: 40014 - DNA, 2992 bp, Homo sapiens
  misc_feature (2984)..(2984): n is a, c, g, or t
ctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagctttattggtttttttttttttttttttttttntttttttt

SEQ ID NO: 40015 - DNA, 3201 bp, Homo sapiens
  misc_feature (3197)..(3201): n is a, c, g, or t
ctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctatatgtatatttatatatatctggggtcttgtctaccacctcccctggtcagagcctgagtgggtgctggttgctgtgtcttgtctgtaaataaactcctatcatgcctttgcttggagtctgtgatccatctgatgctgcccccacccccacagtcctattttcccagctaaagaccaggagagtctccggctggctcccaactggggctttgcatttctctagagttcatctctgagctgtaagggtgaccagggggcagggggacgattgtgtatcagctaggctgcttttggctgcaagtaacaaaatatcagatacaaataggcttaaacattaaagagatttgattagttcttaaaaannnnn

SEQ ID NO: 40016 - DNA, 2752 bp, Homo sapiens
ctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgc

SEQ ID NO: 40017 - DNA, 3232 bp, Homo sapiens
  misc_feature (3228)..(3232): n is a, c, g, or t
ctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggaatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgcctttgcttggagtctgtgatccatctgatgctgcccccacccccacagtcctattttcccagctaaagaccaggagagtctccggctggctcccaactggggctttgcatttctctagagttcatctctgagctgtaagggtgaccagggggcagggggacgattgtgtatcagctaggctgcttttggctgcaagtaacaaaatatcagatacaaataggcttaaacattaaagagatttgattagttcttaaaaannnnn

SEQ ID NO: 40018 - DNA, 2201 bp, Homo sapiens
  misc_feature (2197)..(2201): n is a, c, g, or t
aggaaaggcttgcacaatttcccgcggcgggacgtgggtcgccgggcccgcccggcgccagattaggagtggggctagagaaggggcgaggacgcgaggtgtggcgtcctggggtctggggatgtgaggccagggcctccgaggtgaactggtcctgccctttcgaccccgtgtgtgccctccctcaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgcctttgcttggagtctgtgatccatctgatgctgcccccacccccacagtcctattttcccagctaaagaccaggagagtctccggctggctcccaactggggctttgcatttctctagagttcatctctgagctgtaagggtgaccagggggcagggggacgattgtgtatcagctaggctgcttttggctgcaagtaacaaaatatcagatacaaataggcttaaacattaaagagatttgattagttcttaaaaannnnn

SEQ ID NO: 40019 - DNA, 2071 bp, Homo sapiens
  misc_feature (2067)..(2071): n is a, c, g, or t
aggaaaggcttgcacaatttcccgcggcgggacgtgggtcgccgggcccgcccggcgccagattaggagtggggctagagaaggggcgaggacgcgaggtgtggcgtcctggggtctggggatgtgaggccagggcctccgaggtgaactggtcctgccctttcgaccccgtgtgtgccctccctcaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgcctttgcttggagtctgtgatccatctgatgctgcccccacccccacagtcctattttcccagctaaagaccaggagagtctccggctggctcccaactggggctttgcatttctctagagttcatctctgagctgtaagggtgaccagggggcagggggacgattgtgtatcagctaggctgcttttggctgcaagtaacaaaatatcagatacaaataggcttaaacattaaagagatttgattagttcttaaaaannnnn

SEQ ID NO: 40020 - DNA, 554 bp, Homo sapiens
gaaagaaacaaggatacagaagacctacgtcacatatcaacagggtataatgaactggcatacatagatctctataccctgaaaacagagaatatgctcttttcagtgtccatgatatacttttaaaaactggccaaactgatcccttaataagtccaataggtctttcttctgggggtgggggggaacaaagcaaattattaaataatctaatcaaaaaagaaaaacacaaatatccaaaataagaaataagagcagaaatactagaaaaatggaggtaattaaaagataatattcaacactattcaactgtatataagtaaatttgaaaagctgactaagtgaattatttttctgggaaaatataatttatccaaaatcactccaagggagacatgaaatccaagcaaatcaatcatcatagaaaaaataaagttctaaataaggcccccaaacccgacagcttcacaggagatcattccctgaatttttctgtgtgaagaacagaaaattccactataaaactattagaaagcaacgaacttaaaaaaaaa

SEQ ID NO: 40021 - DNA, 367 bp, Homo sapiens
gggaatgaattcctccaaaaacaccccgtttccctgcctgtggagccaattaagccaagcaaggctgtacctttaattactgctgccctcatttgcatctggctgccctcattatagtgctattagcagagtgcaggggtcctcctgctggcccatcaggagtggtgcgtgcacagttgtggggccttgctttggtggtctttgctgccttctgggcaaaatgaaggatttggagtagacagcaagcaggcatacatcctgggccagaagcagcctgcggagctcatcgtggcttgccttaaattgtttctcaacaataaagttgttgaaaaacaatttgtgttttctttctccttattaaaaaccc

SEQ ID NO: 40022 - DNA, 155 bp, Homo sapiens
aagaatggggtgaggaggatgagggggagaaaatttgtcagaggagatcctaggctttttggcttaagtgaaagacagctagtgaccttaatgagcagttttggtagaggtgagttcagaagagaatgggaaatggcattttactgtaaaaggca

SEQ ID NO: 40023 - DNA, 233 bp, Homo sapiens
taaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctt

SEQ ID NO: 40024 - DNA, 392 bp, Homo sapiens
gttatgttgatcacaactcatcatggcccacaaaggagctgtaaccaatgtttgagaaacacaagacactattctgtgtcaatcagtgtatcactgccctggagctagaaaatagtaaccactaacccctgagtggtacagtgtacttaatactgttttagcactttacatgcattgttttatgtaatcctccccagcagccctgtgaggcaagtattacctccattctgcaaaaactgaagcatcgagaagttaccaagattcaaactgattgactccaaagcctgcactcttagctgctcccccacctattaccgcccaaataggcaggaggaaaagagctctgtgacagttttaataggctccaaacagagatgagattgagggtggcg

SEQ ID NO: 40025 - DNA, 384 bp, Homo sapiens
aacctgggaatggcaaatatttagaggaattctaatacaatggcagaaggagaaggaaattaaagtttggtgggttcttctcttctctgcgttagatttaaaagtatttttgtctagaaatattacaaatttgcaggttaatttaaagggacatttttctctttgtaactttatgaataaatggagaaaaatattctctgtatgtttcctttgttccagttttaaattttcctttattatatgttttacttttaggtcatttcccatttttctgacttggttttgtatggaatttgacagaacaaagaaagcatttaatgatggagttatataaattctttatcttctatgacaggctaaacttactggaaataaatgttgatg

SEQ ID NO: 40026 - DNA, 799 bp, Homo sapiens
ggcagctactgctacttttaaaagtggtaaacagtaccatttcgttcaagtttagccagtatgacctaaagtgtcacaaaagcatcaccgtaagaataatgtaagaatgctatcattttataaatcccattgttctgcctatatgcccgtggcacgtgttcagtgattatttacaaatgtttgacctgccctgctccctactgagattcttgaggaagtcctggctcatttttatggccacatctctactgctttccctcagctcactgcctttcacgtatttgtgggtttgcctgggtgccatggatctccaagggttctgtgaatagagttcaggggttgatgaattgggacagggggaaaaaaatgcattttcagtgactctgatatttagcatttccttcaattatggatgtaggccagaaacttcagtagtatttgtagtgcctgtcactttgtcaccagtagaattcacagatattgtcatcacacatcacggttacttagctacctcaaaataccacttatgctcatcacaactttgaaattacagtggttattagacctgccgctagggtttgttgcttgaagtgttaacaaagaagtacatgcatcactatctcataaattgctttataatattttgataacaggctgggcaaggtggctcacgcctgtaatccttaacactttgggaggctgaggtgggaggatggcctgagcctaggagtttgaggctgcagtgagccacgatggtgccactgcactgcagcctggatgacagggtgaaacccttctc

SEQ ID NO: 40027 - DNA, 192 bp, Homo sapiens
tccttaacctaatggcatcttttgtcttgtaatatttactcttttaaaaaactatatgtgtgtgtgtgtgtgtatagatacatatataagtgcaccctactactcacaggttatggggaatccaatgtgtgtatattggggggctactgtaccatcagcctgctccaccgtgttacctgccccacagtaggt

SEQ ID NO: 40028 - DNA, 952 bp, Homo sapiens
aatttcaacagaagcaatgccttcaaacttgtgaaagaaatttccaacctaaaattctgtatctgactaaatgtaacataaaagtcaaatgaagagtataaaaaaatttgcctcctatatatcctttctcaagaagctactaaaggatgtgcttcataaaaagggcataaaccaaacaaaatgacataggatgcaggaaatgggatttagcacaggagagaaatgaaagaaatccccagatgatgaggatggaatatccaaggatgaccactacaccaggcatagagagtatattgaagcatatcagaagatcctggccacatgtttttagaaagattaataaaatatccaatgtatctcagtatcttaagagtgaggcaaccagcaaactacgaggttcttcctgaaacaaagcctgagtcaagaacgtgggttagtttattttagagatcccagaaactaggagtgagggacttgtgatattgcgaaggagaaaggggaaagtcagtataaaacatggtgtattattgaggtcatttctgtgtagacagtgggagcttgattccaccaggtcctcaaagaagctatgtgatagctccctgaattgcctcctgaaagacaagtggctggagcatttaaccgtacgctgtcatttttcactcatcaagttgctgccaagggcatcatctccttgcacatggggcagtttgcacatgggcacagtaggctccttaagtgtcaaagaagaccctgagacagaaagctgaaagagtaggaaatgggtcttcagttcccatggagctgtccactgatactggctggaatcagaaggtgggtggaggagatgcttttcaaggctccagggttcaatcagaggtgacagtgattctggagaaaaaccaaccaagccaaacaaaaaactggcagttaactccaggaaagcaaaatgggc

SEQ ID NO: 40029 - DNA, 338 bp, Homo sapiens
gaggtagagtctcactctgtcacccaaggtggagtgcagtagcgcgatctcagctcactgcaacctccacctcctgggtttaagcattttcccctgccttgtgcctcccgagtagctgggattacaggcatgaaccaccacacctggctaatttttttgtatttttagtagggacgggtttcaccatgttggccaggctggtctcaaactcctgacctcaggcaatccacctgcctcggcctcccaaagtgctgggattacaggtgtgagccaccacacccagtcttgtttttacatattaaaaatacccaatctgggcctggcctggtgtaaaaaaa

SEQ ID NO: 40030 - DNA, 982 bp, Homo sapiens
aaggacaaatatccaagtgaccgtgacggggcctagctcaccaagtcctcttgctgtggtacagccaatggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttaga

SEQ ID NO: 40031 - DNA, 1221 bp, Homo sapiens
aaggacaaatatccaagtgaccgtgacggggcctagctcaccaagtcctgtaaagtttctgattgacacacacaaccgcttactccttcagacagcagagcttgctgtggtacagccaatggcagttaatatttccgcaaatggttttggatttgctatttgtcagctcaatgttgtatataatgtgaaggcttctgggtcttctagaagacgaagatctatccaaaatcaagaagcctttgatttagatgttgctgtaaaagaaaataaagatgatctcaatcatgtggatttgaatgtgtgtacaagcttttcgggcccgggtaggagtggcatggctcttatggaagttaacctattaagtggctttatggtgccttcagaagcaatttctctgagcgagacagtgaagaaagtggaatatgatcatggaaaactcaacctctatttagattctgtaaatgaaacccagttttgtgttaatattcctgctgtgagaaactttaaagtttcaaatacccaagatgcttcagtgtccatagtggattactatgagccaaggagacaggcggtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagccagcaggaggagcttcatctgttcccttcccacctccaacctagccctactgcccaccccaccccggacacggatacgga

SEQ ID NO: 40032 - DNA, 500 bp, Homo sapiens
tctgtagccttggggaggaatggaggaggaaggaggagaagaccatgcccatctttactctgtctcctactttagtttgtgagtgggacggttaagtcaaaacagtgacgagagattaacttatttgctgagttctatttacattcagaatatagtgctagaaaaggcccagataacaccatgtgctagtagtatacatgtgcacattaggaatctaaagtgtcttttactgactcagactttaataatagtcctgtccacccccaccttttcgccctctctctccccttctctctctccctctctcgtccaagtttaaattccttactggaaagacaggaaaggaaaagttcgtagtagattttccaaatacaaaccttgcttttataatatggttatggcaaccatctctattttggtaaaattggcctattatatgaatgacattttgcaagttagatttttgcaatttaggaaaaccacaagccatcgtaaacagt

SEQ ID NO: 40033 - DNA, 730 bp, Homo sapiens
gagcaggaaaagttagtagcccaagaaattgttcttggattctatgcttcagacctgtcagtctgagtcaaggtaaaaactcttaactttattgatggtactagtgcttcagcgtcaataaaaatatgttggtaattccacaaatattttcagatttcatatgtttttgcatttcatgaactccttaacgcctaagcccagttcttatttgcccttatatcattgcagataacctcagtgccttgagcataataaatattctgtacatgtttgatttgttgttaagcacttgacagatacctgtaaggcaccatagtttctaacttaagctgactagtcactatggatctcgacaggaccctgaacaaaactccattgttgatcctattttgcacctagacacaattattctttggtagattcacataataaaggttatgtttgcaatcctatttctaaccaaagcattaaactgagtctttaacttatcgatcactataacttgataatgaacctctgtgtgtgtgtttgtctgtgtgtgtctgtgtgtgtgtgtgtgaaaggatggagaaaactagaaataggcatgtgtgtttttctgtgctatttgctagaatggcaaatttttcttcattatttttctgcaaaacaatttgtagaaaaacatttttcattatttttctacaaaacagttctcggccaaataggtttgctttaagttaagattaaa

SEQ ID NO: 40034 - DNA, 339 bp, Homo sapiens
ctgacccacgatggtgggtcagggtaggcctgattgagagggtcatgtctgagcaaagatttgcaggttaaggagttagccaagggggtatttggggaaaaagtgttccaggaagagccacacatctagagtgaaggctaaattaggagtggagcatgcagaacttttaggccatttaaaggacttcattagttgtgcctggtggtgcacacctatagttggaggtatgggagaggctgaggtggaggaattgcttgagcccagcactgcagtgagctgaggtggtgctactgcactccagctactgcactcacagagtgagaccctgtctctgttaga

SEQ ID NO: 40035 - DNA, 177 bp, Homo sapiens
aaaggcgaggggaggcaggtctgaggcagaggagccagggcaggtgcggcgcttccgcctctggtcccaaagcaaagactcccctgtgactgacagcccgtgttatgttaaatacattttgttggtttgtaattcaaatcccataaagcaggaggtagagagccaaccattctggag

SEQ ID NO: 40036 - DNA, 461 bp, Homo sapiens
cattatcttcatttcataacatttttttccattaaagatatttggattatattcctacttctgaattgctctttgaatcacagacgtttttctgaggttcagcttaacgtattgctacttgaatctgattttatcaagtactaataggatatgaagcattaataggaattatcattagtgaaataggccaggctcagtggctcatgcctgtaattccaacactttgggaggccgaggcaggcagattgcttgagcccaggggtttgagaccagcctagacaacagggcgagaccctgtctctacaaaaaataagaaaaagccgagtgtggtggcggcatgcacctgcagtcccagctacttgggaggctgaggtgggagaatcctgggagatggaggttgcagtgagttgagatcacgccactgcactccactccaggcaaaaaagctagatcctgtctca

SEQ ID NO: 40037 - DNA, 417 bp, Homo sapiens
gaactatattatatgcctctttgtcattattttatcagttggcaccctgttttgttttgtttttactgctgaggtatcagtaccctcacccactacttgttgtccatttaaaatctgcttaccctagaacttcacctctggctcacttgttcccaaataagccctggtactgcttctcatttttcctttctcctcagtttagaaataaaattttaacagaaaatttaaaaattggttccacactcagtattataatgatctcaaccaaccattaaagggtctgaatgacttattactatatatctgaattattgtattcttcttggtgtaattattattatagtattattatctgaatagctttttactgtaactcagaatgatggccttaattttctccaggtgaatttactttaa

SEQ ID NO: 40038 - DNA, 474 bp, Homo sapiens
ggagatgtggctatgagattgacacaagttttcttaagagcttcatcaaacatatggaagcagttccaaaaagtttcccaaatatttttgggcagtggcagcagtaactcagagttttaaaattcaaatcagaattttaagaaaccttagagattattcctttattacaaatgaagaacctaaggttcaggaaaacttttgacgcatcagttggttcagatagtcagtggcagaactgcaaagaactcgccctctgactcccagttgagttttagcctgaacccccattcactcccatccaaaaacaagtgggggtgggggttgcagggagggaaacaagtttcccacaaactgaattttaaaatattgcagaattttgctgggtgttctctgcaggtttaccagtctgtggaaaccagaatcagatgtcagacatacatgttccttatgtgcagtcttccaccatcttccttt

SEQ ID NO: 40039 - DNA, 316 bp, Homo sapiens
gatcacttgagctcaggagtttgagctgtggtttgccactgcactgcagcctgggtgacagagcaaaactgcattacaaaaaaatgtgggagcagtaggatgtgctgaaggtacccaggtgaatatgtgggtaaaggacaaaggtgagggtgcctctagggttttgggttttagttcatttttgagacagagtcttgctctgtcaccaaggctggaatgcagtggcgtgatctcagctcactgcaacccctgcctcccgggttcaagcaattctagtgcttcagcctcccaagtagctgggattacaggtgcctgc

SEQ ID NO: 40040 - DNA, 328 bp, Homo sapiens
tccaggtacataaatggcactcagtaagactttgctattagacacatcattttaagactgcccacagagtaaacaacaggaggagctctgctgtaatagttgacataaagcagaaagactctgtgtccagttgatagtactatcagttccttggccaatttccaacttacgttcttcccacgtaagtagccagatcctccccactctggtgaaaggaattggctcttataaaactaatgaggaacatcacaggcctgcataatgaaagaggtcattctgtccttccttagcgtgcctgtgtggcacaatgctattaagttagaggggc

SEQ ID NO: 40041 - DNA, 217 bp, Homo sapiens
cagtcctcaatgagcacaaatgccaagctgcctcaagggcagagtctcatgagattttacaaaacacaagggccaaggagactagggagttccctcacctcattttctcattttaaagataggggccaggcacggtgactcatacctataaccccagcactctgggtggctgaggtagaagaaatgcttgagtccatgagttcaagaccagcctgag

SEQ ID NO: 40042 - DNA, 279 bp, Homo sapiens
gcaaacatctggcagtggcaaaatctttattttatttagctgtatgaaatacttagttttgaagtaaaaaatagggaagctagaatttatttaataagtaaaatgagtatcacatagtctcttactacatacagaaagaagtaaagaattcaacaattcttgccaggcaccagtggctcacacctgtaatcctagcactttgggaggctgaggcaggaggattgcttgagttgagttcaagaccagcctgggcaacatagtgagacccctcatctctac

SEQ ID NO: 40043 - DNA, 434 bp, Homo sapiens
tacttaagtaagtatgatgttgagtaattacacttagtacttgagttagtttctctgtactctggtgtaggatgtttatgtgggtaaagtcaaaatcactttaatagtacaatttcagccttgtacaccctcaaatgtgtgtgagtgttaaagagtatgccctgtattgtgtttctacatgcctctttcttgtgtgccaaataagaactatggtgtgcaccttcattttcatgcagcaaaaatatatagtaatatgacaaatattaggaaataaagtatgggttgagggcaaaaatactgtaacatggccgggcctggtggctcacgcctgtaatctcagcactttgggaggctgcattgggtggatcacgaggtcaggagattgaggccatcctggtcaacatggtgaaaccttgtctctactaaaaatacaa

SEQ ID NO: 40044 - DNA, 458 bp, Homo sapiens
gataacaatattatgcttctccaagctcagtatctttctgattttatatcaaagtaccgcaacaatgcatcattgtagttaatttatttcaagaataaattcctcatatgtcctcaatagtacaattctaattttcttctattcataagatgaaagaaatggtttggagcatagaatagaaagtgcacaaattgagtacataaaatgggaagcaactgatttctcagctaagaaaggctcatttatcacagaacacaattgcttttctccccccactacgcttcccataattgaaaaagtgagtccctatttttcacactcatataaatctatgcgatttggatgctagtcttattgtattattttgtaaaactttctctttggctcataatccttcctaattgtaaattgataaactttgcggatgacatctgctcgtagaataaacacttcttcca

SEQ ID NO: 40045 - DNA, 421 bp, Homo sapiens
ctccctggtgccatctactcttagtacactttttactactgctaaatatgaaattaaaatagacttactgtagggactcccagatgctcttgaaaagatgaactttatatttaaagaaacctttcgatttcgctcaaatgcaggaaattagggagaatagtccagttttgactttcaagaaaagggtgttattttaaaaatctaagacaaagattagaggagtcttagctttccactggttaagtcctgttgaggcaagctgtattccagtgttgagtctgcagcggccgaagcagccccgaagcagctgtgcctgccgtgggcagtcagtctcggtgcggccatccctctctacacccaggaaggattctgcagaggcgtcactggggtgaattcatgccaagggttgagtccatttgtg

SEQ ID NO: 40046 - DNA, 140 bp, Homo sapiens
gtagcttaagcagtagagcaaactggaataactagtattcatgcataggtcattgtgacaccagagtccctgttattaaacactactcaatattgtctcctatcagaacatatgaggttgtccaggcgctcagagatgag

SEQ ID NO: 40047 - DNA, 512 bp, Homo sapiens
tggagctggaggccattattctaagtgaggtgatggaatggaaaaccaaatactgtatgttctcacttataggtgggagctaagatattagtactcaaaggcatacagagtgatataacggattatggagactcagaaaggagagggacggaggagggggagtaaaaacctatgtattgggtacaatgtacactactcagacgaagagtgcactaaagtctcagattttgccattatataattcatccatgtaaccaaaaaccacttgtaccccaaaagctattgaaataaaaacaaattaaaaagaaaaatacatttaatattttcaaaactttagtgcctattaaacattcattcagcagtggagtgtaaggtgtgggccaggtatctgtcctaggtcctgggaactcagcagtgagcaagacagacacaaatccctacactagtggagcttgcattctaattgatacacctgtaattactaaacaaaatgaggacttgaaaaagagaaa

SEQ ID NO: 40048 - DNA, 178 bp, Homo sapiens
caggtgtgcacttaagaaaccaaaataatctaagtgaaatacctaatatataaggccgggtatagatgcttctcagcttacgatgaggttatgtccctcatcataagttgaaactattataaacctaaaatgcatttactacacctgacctactgaacttcatagcttagcctagcct

SEQ ID NO: 40049 - DNA, 361 bp, Homo sapiens
tattcactatggtaaacagtaatccacattatggttgtgaaaatatttaacacaattccatctttggtcagttctggtttactgacaagtttctttaaaattttgacttaaaggccttcttgactcaacctcttcatcaaagtttagcaggaataatgtaaaaactagacgaaaatttatctgtaaatatacacatatcatgcaaatatatattctaaattccaaaattatataagaagtaaaacctgcttgtcaaaagaaatcttatttggataaaatgtggttaaaaataagttaattatgatattgaataaaattgtcaatttcaatttaaataagtacagaatagaaactacagtaa

SEQ ID NO: 40050 - DNA, 132 bp, Homo sapiens
aaaagaccattgctgacacccgcgtcctcccacccacaccttccgcctgcagggggagctggatggggaagcgaatggggtccctgtgcttatggaggataaacacatggaggcttgcacctcttatttgaa

SEQ ID NO: 40051 - DNA, 777 bp, Homo sapiens
ccatatttcagggacttattttgaattaaatgggtaataaactgactaatatttctgctcagtgggtaggtgtgctttattctgtttgaaatgggagaacttagttcagagaactttttccatagatgcatgatcctttttggtacatactcgaattaggctgttgtgcagctaattcagctttgctgtatttcttttgaagtaagcatcctgatttaatggcttttccaaggactgcctttagtgtgggccttgctaacctgatagatgtcactttactcaacataggttgtagctcagcctgggctttagaagtttgggattgaaaatgagactgtaagatcccagttggcccaaggaaggcgagtccgtttactcatgattcatcttgaggaagaagagatgctgagacagctggcacctggcgttattccaggggccacattactttccgccagccatggcttccaggtgttagatcctttcatgaataccaggaaagcagtgatctattaataactttaccccagctacagttcatgcttctagagttaccattgtgtggatttccagaacttcttttcctttgacacttatctttatcattgtggaattatgcccatgggccacccagctctcacacacccaaagccatggactctaggaagacactcagtttggcggttaatcccttcccttgggaacttttggaattatcactttatttatctaatcctcttcaaataagagtttgtatacttttcactgcatgcttaa

SEQ ID NO: 40052 - DNA, 374 bp, Homo sapiens
taatacaaacttacacaaatataaaatcattcaaacttaatacaaataatactaatttccaaatacatttcatttactttgtatttgttaaaatttttacgtttgctttatcaggacctttctctctccccctctggtacccccctctctttctctttctctttctacacacacacacaccacagtctgtttttctggaaccaattaacagtagctgtagacatgatctcccattacccctaaataactgagcatacattttctaagacaaggacactctcttagataatcacagcgtaaccatcaagtttatgaaatcagtgctttcaccttactcacattctgccagttttctcaattatgccccttatggc

SEQ ID NO: 40053 - DNA, 409 bp, Homo sapiens
tgaacccgggaggtggagcttgcagtgagccgagatcacaccactgcaccccagcctgggcaacagagtgagactctgtctcaaaaaaaaaaaaaaaatagaaaagaaaaataattaaacacatacatgtccataggcaacagcactaacgcatgcctgaacaaaccctctctaacacatgtgttttctctgtaacgtagtcactcctgccttgctctcactgcacacgggggtcattcttaacatcgacacgaccgcagaaagcacaaaaatgggaaaaatttggcactaagtagaccatgaaaaggatacttgtttgcgatgtgagagctgagatcggaaggcagtgtgagatcttctgaaacctcagctgggaacatgcccctcagacagtggaaatttttttgcc

SEQ ID NO: 40054 - DNA, 189 bp, Homo sapiens
actcctgtggactggggtaaacagggtgggtttcccaggggaggtgagatttcagaggggtcttaaattatgaagataaagatcattgacctaagtgtccatcaacagtggattggctaaagaaaatgtggaaccatatataccatggaatactatgcagccataaaaaagaatgaaataatgtccttt

SEQ ID NO: 40055 - DNA, 556 bp, Homo sapiens
ccacatacacgagataacagaaaaaagctatgtatgctttggtccaaataagcaagcattacagactgggggctgggcctctcttgtgctgcagacctgtgctgccatctgcctccctgatgtttccaatgggccttttattccttgccaccaaacattcttccagggttcctcatctcaataaacagcacccctgtccacccagtggctcctgccaggaacctagttgggagcaattcttgacaccttccttgacctcctcagaacctgtcaccaagtcctgccgccaaagctgccaattctacctcagaaatatttcatctgtccacagcactgtatcatcacggccaacagccctgtccaggtcccctttactcagatcacatatttacgggcatctttactccagcagaaagagcgcagccttgctggttttccctccccctacacacattctggcccctttcattccttcaccctccactgatgtcaggagtgatcattgtattgcgtcactgcactccaacctgggcaacagtgagaccctgtctcaaaa

SEQ ID NO: 40056 - DNA, 357 bp, Homo sapiens
caaaaaaaaaaaaaaaagaattactagatgttcgtcacaggaggtggttcagattatatcatccccagtattgctgagccagatcctcctatttattctcaggaacaagttcccaaatgctcacagccacagtagaaaaaaatgtttttccatacgactgcttaaagccattctctctgaaaggaacctggggaaagtgctgtcagtagttaactagagatcgcagcatcctcaggaaaatatccaggggtcaacagttttgggcccactacaacactgccctccagggtctactgtccttcacagttctgggcacagagtcaggccagggatctccggaacatggtgaaaggaagg

SEQ ID NO: 40057 - DNA, 808 bp, Homo sapiens
tggcacacacagccagccttaggctagcatcttaaccagagaagatacatgctactttgtctgggtgttatctcattacctttatgtcactgttgtcttcaaacttaattatgtagtaagctggtgaaataaaacagctttaatcaagagttcaactggagagcttcttagccagccaggcccctccctaaactgaagcccataatccacacagtccatcctccctgcagagcttcctacagtcatcagctatttactcatgatgacacacttgtttggccttcttcttaactttccacttttttaacagatgatagtagaaagatggtcagagagcccatttctcttttctggttttatataatgctacatattagagctcaaaagggcctagggaaagtgcttcagcctctgcagtgggtaaggaaggggttattctcctcattttataaatgaggcctttgagacccagagaggctatataacttgcccagaccactccactaaggggttgttggggcacttcatatttctctgcttctatcagtaaccagcctttctttttgttggtctttccactctgactcctccagggcctcctcttgagcctgtttattgtcttagcctgaggccccaccacagtggcatcagagggttaagagcgttttcagattgagggcaagtcttttccatacctaaataacaggggaaaagtactcctccttaaagttaggagtaacgaaatgatggatgcaaagtgctgactaccacatgtggcataaatgctcattaactgtgatgatgacgt

SEQ ID NO: 40058 - DNA, 483 bp, Homo sapiens
taaacctgtatggcttggtatgcctcagactgacccaagaaaggaaagtcaggatgaatcctgtggaaaggaagtgtctttccttgcctgtccctgcacccactgcctttggaggtgcctccttgcatcgtgtcttaggatgtgaattaatgctgaggtttagaatacacatttacatgatgacccacctgaagtgaccacaatcagagcaagtacagtctttggaagcatgtactgtgtgctgaagccctccaatgtggaagggcttagttaggtatgtagttaggttttgatgttggagaagagataatggacacagaagttgttccaaaaggagaatgagtgcattgctgatggtgccggtgactttttgcctcccaacagttgtcccccaaccccatttcttcttccctcctagagatggtcaattgggtcaggaggcagaaagagatcccatgtacttagggagagtacattgttctg

SEQ ID NO: 40059 - DNA, 1879 bp, Homo sapiens
gggacttcccactgcctctttagcacaaatcggacttgaacaaaaacaactctttttccatgggaccaattataaaaagaatggctttgcactgagcagctcagtctactggtctcatcagtgaaaggcttgtgaaaatttctggaaagagcattggctggcttgttcatctctctgtttggtcagttgctgtgtttctgccggatcagatgagcagattggttagtgaaggtcagtgtgagaagaagattgtttctgagcttgagaagcttctggaggattgaagagtatttgaagtctgtgtcaaacatccatatcataagtggaattttggagatattcaaagaatgctgtcagaagggtatctcagtggacttgagtactggaatgacatccactggagttgtgcctcttataatgagcaggtggctggggaaaaggaagaggagacaaattctgttgctaccctttcctattcctctgtggatgaaacacaagtcagaagtctctacgtgagctgcaaatcatctggcaagtttatctcttcagtgcattcaagagagagccaacatagcagaagtcagagagtcacagtgctgcagacaaaccccaatcctgtgtttgaaagcccaaacttggctgcagttgaaatatgtagagatgccagcagagagacctacttggttccatcttcttgcaaaagtatttgcaagaattataatgacttacagattgcagggggccaggtgatggccattaattcagtgacaacagattttccctctgagagcagttttgaatatggccctttgctgaagtcatctgagattcctttacccatggaggattccatttctactcagcccagtgactttccccaaaaacctatccagcggtactcatcctattggagaataacaagcatcaaagagaaaagcagcttgcaaatgcagaatcctatttctaatgcagtgctgaatgagtacctggagcagaaggttgtggagttatataaacagtacattatggacaccgtgtttcatgacagttctcctacccagattctggcgtctgaactcatcatgacaagtgtagaccaaatcagtcttcaagtgtctagagagaagaatctggagacctcaaaagccagagatatagtctttagccgcctattgcaattgatgtcaactgaaattactgaaattagcactcctagtctccatatttctcagtatagcaatgtaaatccatagagaggatgcttccattactgtctcgcatttacttaaacatgaagcaacactttatccatttattctgagaatgtgcaggaggggttagtgaaggggaattaagggctagagaagtaaagatcagctggaagtcatgtgtgaatcatggagaaatctcataatattacacttgatgaaggaatatggtaagaggagccataaggaatgatttcaaagagaggtgtgtacagcaaggaagcaaaaataaaaatgatcaaaaaagaaacggttaattcatttgaagaaacataggaattaaaaaagaagacagtcaaatgagatgaaacaaaaaggccaaaaggtagccgggtgtagtggctcacgcctgtaatcccagcatttgggaggctgatgtgggtggattacctgacgtcaggaattcgagaccggcctggccaatatggtgaaaccccatctctactaaaaatacaaaaaattagctggacatggtggtgggtacctgtaatcccagctactagggaggctgaggcaggagaatctcttgaacctgagaggcagaggttgcagtgagccgaggtcgctccattgcactccagcctgggcaacaagagtgagactcccgtctc

SEQ ID NO: 40060 - DNA, 401 bp, Homo sapiens
tttttttttttagacagggtcccactctgtcccaggctggcatgcagtaggatcatctcagctcactgcagcctctgcctcccaggctcaagtgatcctcccacctaggcctcccaagtagctgggactataggcacatgccatcatgcccagctaatttttgtagagaaaatataattattataacaggtataaacatatccttctaaattaatgtgaagcataagcaaagctgggaaaagtatatcactatccacagtatgtcatcctttatttcttagaaatgtattactgagataaagaaattttaatttggaagtttttttaaataataaaagactgaagtttttattttaaaaaatgaggtccaataaatgtcttctaaactacaaaacttatgt

SEQ ID NO: 40061 - DNA, 456 bp, Homo sapiens
gcacccccacctcataagctcctgacctacaggataagagctgtttcctgtgaggggggcctggggctgccctggcagtggctcttgggcctcctggcccaccagaacgtcctggcaagctcacaaaactcacaaacactgaactccacttctagagattcgaatttgggagctctggggcatgagccagagatctgcaggtgattctgacaggcagccaggtggagacatgggggtgagagatgagttttctttgcagcccacccagagaggaaaggcctttcctttcaaagagcctcagaaagcaatggtccaggtccttcctgcttcctgggagatgccacatggctctacttctgaggggtctgtgcagtgggtgtgggagcacctggggctcttgggtgtcaggtgtcctatgtcctctcccatggtctggggagagcatgcacttttggt

SEQ ID NO: 40062 - DNA, 412 bp, Homo sapiens
gctacacggtgaaaccccgtctctactaaaaatacaaaaacaaaagtagcctgtcgtggtggcaggcacctgtagtcccagctactcgggaggctgaggcgtgagaatgtcgtgaatccgggttgcagagcttgcagtgagccgagatcgtgccactgcactccagcctggccgacagagcagactccatctcaaaaaaaaaaaaaaaaaaaaaacgcaaacgcatactatcgtgattccacagttgtggtaacatgcagaatactttgactggtccaaataatgcccacgtgcttcacctattaaacctcctcactgaatcttttgccagatcatttacttttttaggaagtaatattcccttatatgacgtatcacagttttttttttttccattcatcaattatgagac

SEQ ID NO: 40063 - DNA, 3083 bp, Homo sapiens
caatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccagtactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcacccccacttagcacccgaagacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttgctggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttgattcctttggcccggagatggctgctagctgtgttttgaaatatttcttagacaagcctttcacaacatttcatcaattgaactaaacactccttcttagcacttcctgtgccaagaaatctggaagtatagaagtattagaagattgccctaggcctcaagggacttatagtttatttttgagaaacaagggcaaaaattaaaacctatttaagaacaataaaagtaatatgacataaaggtctaaaattaaaaataaaataccaaaatattttataagcaacagatgtgtaaggcactctaatatttaaagtgaagaatgaaaaatatgtaagagtctgctttatatgaatataatatggaaggtgaaacatttacttaaactattgcaatgcattattaaaagatgacgataaccacaaaagatgtaaaaataaattacaatgggggtt

SEQ ID NO: 40064 - DNA, 821 bp, Homo sapiens
tgcggatagcgaggctgcggcaggaggagcgggagcaggagcagcggcaggcgttggagcaggcccgcaaggccgaagaggtgcaggcggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttc

SEQ ID NO: 40065 - DNA, 410 bp, Homo sapiens
ggcctggcattggggtcaatcaacacccgccctgttattatacaccttgtgggcacaggtggctccggccccacccagggccctgcatctcctctcatgccccgcgtccccaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttc

SEQ ID NO: 40066 - DNA, 2649 bp, Homo sapiens
ggcacgaggctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttctttcctccctggtcgtggtacagattccagggttggatctttggttgggtgtggcacagagtctggctcctgctaggtgagacctggccgtcaaatgacacaaacaactaaacgatggaagagagagcga

SEQ ID NO: 40067 - DNA, 2575 bp, Homo sapiens
ggcacgaggctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttcaaaaaaaaataacaaaaaaactcttcgggggccactatggggggggggaaaaaacg

SEQ ID NO: 40068 - DNA, 2650 bp, Homo sapiens
ggcacgaggctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcaggcacggcctgggcaggctgggtggcgggggctgaggtggagaatgtcgggaatgggggctctgaggaggtggtggctcagtggcttttcaggagccagcctgggtcccaacctgtacctcttgccttgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttc

SEQ ID NO: 40069 - DNA, 2038 bp, Homo sapiens
tcagcatcaaagttagtataggctttgacagacccatatgcacttgggggtgtagagtgatcaccctccaagctgagcttgcacaggatttcgtgaacagtagacattttgaaggaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttc

SEQ ID NO: 40070 - DNA, 2282 bp, Homo sapiens
ggcacgaggctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggcagccatgtcagccaggacagtaatgacgacaggcagagctttcgcacagtgcttcaaggagaaggacggatgcacatacgacgttaagatcgactcccttggatgagacgggccggaaactctcattcaagtaggctttacgagctatctgtcgcaccgcttgcatgattaagggctggcgggtgctctactc

SEQ ID NO: 40071 - DNA, 2519 bp, Homo sapiens
ggcacgaggctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttc

SEQ ID NO: 40072 - DNA, 2853 bp, Homo sapiens
ggcacgaggctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttcaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggctaataaattatattccccgggggggagcaccacgactattagtaccccaccatcttttttttaaacagggggcccccatcaatagagcacttcattataagacagccagcggacggggcgcgataaaacagagcggtgcgagaaacacgctgctcgtggatcatttgtggagaaacccaccccggggggggcaacattaggggcaccctcctcaaatatagccgggggaaataat

SEQ ID NO: 40073 - DNA, 2553 bp, Homo sapiens
  misc_feature (2533)..(2533): n is a, c, g, or t
  misc_feature (2538)..(2538): n is a, c, g, or t
  misc_feature (2542)..(2542): n is a, c, g, or t
ggcacgaggctgggctcggcggcagccgggctcggagtggacgtgccactatggggtcgtccaagaagcatcgcggagagaaggaggcggccgggacgacggcggcggccggcaccgggggtgccaccgagcagccgccgcggcaccgggaacacaaaaaacacaagcaccggagtggcggcagtggcggtagcggtggcgaacgacggaagcggagccgggaacgtgggggcgagcgcgggagcgggcggcgcggggccgaagctgaggcccggagcagcacgcacgggcgggagcgcagccaggcagagccctccgagcggcgcgtgaagcgggagaagcgcgatgacggctacgaggccgctgccagctccaaaactagctcaggcgatgcctcctcactcagcatcgaggagactaacaaactccgggcaaagttggggctgaaacccttggaggttaatgccatcaagaaggaggcgggcaccaaggaggagcccgtgacagctgatgtcatcaaccctatggccttgcgacagcgagaggagctgcgggagaagctggcggctgccaaggagaagcgcctgctgaaccaaaagctggggaagataaagaccctaggagaggatgacccctggctggacgacactgcagcctggatcgagaggagccggcagctgcagaaggagaaggacctggcagagaagagggccaagttactggaggagatggaccaagagtttggtgtcagcactctggtggaggaggagttcgggcagaggcggcaggacctgtacagtgcccgggacctgcagggcctcactgtggagcatgccattgattccttccgagaaggggagacaatgattcttaccctcaaggacaaaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttcataggggggggggnggggngggnggccagccgct

SEQ ID NO: 40074 - DNA, 1301 bp, Homo sapiens
ggacgcgtgggtcgacccacgtgacctttaaaaagaccaagcggagggtgaagaaaatccgcaagaaggagaaggaggtagtagtgcgggcagatgacttgctgcctctcggggaccagactcaggatggggactttggttccagactgcggggacggggtcgccgccgagtgtccgaagtggaggaggagaaggagcctgtgcctcagcccctgccgtcggacgacacccgagtggagaacatggacatcagtgatgaggaggaaggtggagctccaccgccggggtccccgcaggtgctggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttc

SEQ ID NO: 40075 - DNA, 1126 bp, Homo sapiens
cagagaatgtgggctgtgcgggtgagagcagacagcaggggatctgttgtcatggggagggaaggcgcaaaggggaatggagacagcgtggaaggagagcgtcttgaagatatgggcgctaaggagggaggaggacgaggcggagctggagctgcagaagcagctggagaagggacgccggctgcgacagttacagcagctacagcagctgcgagacagtggcgagaaggtggtggagattgtgaagaagctggagtctcgccagcggggctgggaggaggatgaggatcccgagcggaagggggccatcgtgttcaacgccacgtccgagttctgccgcaccttgggggagatccccacctacgggctggctggcaatcgcgaggagcaggaggagctcatggactttgaacgggatgaggagcgctcagccaacggtggctccgaatctgacggggaggagaacatcggctggagcacggtgaacctggacgaggagaagcagcagcaggatttctctgcttcctccaccaccatcctggacgaggaaccgatcgtgaatagggggctggcagctgccctgctcctgtgtcagaacaaagggctgctggagaccacagtgcagaaggtggcccgggtgaaggcccccaacaagtcgctgccctcagccgtgtactgcatcgaggataagatggccatcgatgacaagtacagccggagggaggaataccgaggcttcacacaggacttcaaggagaaggacggctacaaacccgacgttaagatcgaatacgtggatgagacgggccggaaactcacacccaaggaggctttccggcagctgtcgcaccgcttccatggcaagggctcaggcaagatgaagacagagcggcggatgaagaagctggacgaggaggcgctcctgaagaagatgagctccagcgacacgcccctgggcaccgtggccctgctccaggagaagcagaaggctcagaagaccccctacatcgtgctcagcggcagcggcaagagcatgaacgcgaacaccatcaccaagtgacagcgccctcccgccccggccctgcctcaaccttcatattaaataaagctccctccttattttttc

SEQ ID NO: 40076 - DNA, 1064 bp, Homo sapiens
ctgggacaccacgcacggggcaagcacagctgtgtggccagcggcatgctgacagggctagacacgcactgggccgcttaatgccgaccttggcctgtgagtctgtgaccaggactcttggtgagcggccagctgggggctgttggtgctgagttcagctttgtagccaaaaaggttccagctgatttccagacagacccggcttccgttttcaatgccaagatgagctgggcgaatgagtgggagcggacagaggcttttggccgactgtgatcgctattgtctggagtccccttgaccctctggaggtactgcctctcctttcatttgtacacactggtttttctgcacggtttcgcctcttgtcagctctggggacaccagcttttccgtttcccatactgccagatggctttgagcaaacaagaggaagtccccagcgtgggtgcagcctgtggctgcgttgtcctgcctgtttaccctgggggtgaagcggaaagggagcaggctttgcaggaacccaggtggcaccccttctcgtccctgccacttgttctctttgtggccctgggatggtccccaaacttctctgaagtggtgctgaaaactgtgttgatagcacggacctcactgagctgttaggagtagctgtcgacactgtgtacccgaggttctttccagtggaaaccaggttagccttcgattccttttctttcatctgtggttggtcacccttttgagagctctgaccccaaaagaagtgtttttcagattggcccaagttcctccacgttgggccccccaagacagactgactgagaagggagtggagctgtgggcctcctgattccttcccaggctatgtcccttccagagtggtccaggtgggacgctgactaccagaggcctggccctctgttctgaggcccagttagccatggccttcatctgctcacattctgtgggattgggttgtgtaattttcgttgtatctctctgtcctcattaaatctgaattcctccaaggacaagaaggctgctgctgcttaaaaaaaaaaagaaag

SEQ ID NO: 40077 - DNA, 244 bp, Homo sapiens
ataaaatggctaacaagaggcagaatgaatcttatgtcaatatgctcccattctcaacaatcaatctatttatgtaagtttttcaaactccagcatcagaaatccacatgtagccctggggccatcacattttcttgcaggatggcataaggtttaacacttttgagttatttgaatatacgggcaaccaacagtaggcaagagggttctacagaatgccaagaaatcaaacacagaatttaga

SEQ ID NO: 40078 - DNA, 842 bp, Homo sapiens
agcccagcaacagactgggtgttcagtgtgcccctgtcggtctccacgggggccctgcaagaaggagccaccccggttttacggggggttcagggcttgtggccagatgtgcagctaggcctggatcaggctcccgtccggccccagtgcgtctgccgtgcccgtgaccccaggctgtgtctctcagaatccgccaagattccagggcaggtaactgcagagctcccccgagtcctgtgcacgcctcggctcacactgcagctcagcagcagcaacgcgggtgacagaaaccagctctgtgtctgtgagcctctgcctcaccttctgggggatggcacagtattgctccaagacatgcaaacagctgcgggcagcagagacagtgaggcaaccctgccacactctccaaccatgccctcctcaggcatgcggagaaagcaccccttcatctgtgcaaggaatcctcaagcagcagacaaaattcatgcactgttaattcagatgttacagtcacatccagtgctaagggctgtcctttgaaaacagctgaggtagacacatcttccaagaacaaatcatagaaatgttaccaggcgattgtcttcacaacctctgcatcagtgatggggacttgggggtaagcttttggttggcgttgtgaacagtgccagctccctaaagcaagcttgcttttctgttgtttgaaatactgcaggagaactgaaattctcttaaaatataccggtttctggttcaagagaaatacttttttgcaccaatttaattcaggtttctaaagccgaggcagggatggcatcacagtctgttgaatgaattccagc

SEQ ID NO: 40079 - DNA, 395 bp, Homo sapiens
tggtctgaggatggtattaagcaatcctaatttctaatattactatgcacatataaaggaattcggctaattttttttaatgaatgcatgctgagaaaatggaattccttttttgaacatcattatatgcttctgtgaactctgcaggataatttttgagtttgaaatatatattttgcatattcaagtctaattgcctgtgtttcagggtttgtgatgatatactttttaggtttattactatgtgaatcatatagataagttcatcatcataaataggtacactgatctttgtatacttattgccctctagtggctgtagttatctcaataaggatgtaggaatgaggggaggagtgtatgtatgtgtgtatttgtagaaaagagaagataat

SEQ ID NO: 40080 - DNA, 451 bp, Homo sapiens
gcatctgctgggcttctggggaggccttcaggagcttttacttttggcaaaagggtgcaggcacaccacatgcctagagcaggagcaaaagagagaggagtgtggggaggtgccacatacttttttttttttttttttttttgagaggaagtctcgctctgtcgcccaggctggagtgcagtggcgccatctcggctcactgcaagctctgcctcccgggttcacgccattctcctgcctcagcctcccgagtagctgggactacaggcgcccgccaccacgcccggctaatgtttttgcatttttagtagagacggggtttcaccgtgttagccaggatggtctcgatctcctgacctcgtgatccgcccacctcagcctcccaaagtgctgcgattacaggcgtgagccaccgcgcccagccagtgccacatacttttaaacaactaga

SEQ ID NO: 40081 - DNA, 2807 bp, Homo sapiens
attcttgtttcgtactgaggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccaggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagcactgtaattcttgcacatccaaggatggcaggaaatggaaccattgctttctctgtaaaaagtgtgtaaagccttcctggatccactgtagcatctgcaatcactgtgctgttccagatcattcttgtgagggccccaaacatggctgctttatttgtggtgaactggatcataaacgcagtacttgtcctaacattgctacatctaagagagctaacaaagctgtcagaaagcagaagcaaagaaaaagtaataagatgaaaatggagaccacgaaaggacaatccatgaatcatacatctgctacaaggagaaagaaaaggagggaaagagcccatcaatatcttggctcttaaatgtccagtgactggagaataagaaagatttatggtccaacctttgatgccattttctgaaagtgccacactggacttaaattcagctgcttccagaggtgtgcacctttctgagctagataacaggcaggtggcatttgctggtttacagtcccttatctgcctctctggagacttggggagttgttccatcttcagccagtttactagttctttcagcattcatttttcctcactttaagtctctcccagtcacattgttctatttttatgttttcattttttttgagatggagtcttgctctgtctcccaggctagagtgcaatggcacaacctcagctcactgcaacctctgcctcccgggttcaagcaattctcctgccttagcctcctgagtagctggaattataggcacatgccaccacgactggctaatttttgtatttttagtagagacggggtttcaccatgttggccaggctggtctcgaactcctggcctcaagtgatttgcctgccttggcctcccaaagtgctgggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaaatatttattcttcaagtactttttgcagttgtcctctgacggtctagaatcacttaaatgcttgttgaatgagtgagatgtttagaactacgacttgctctgtcattccagtgtcgtttaacctatgcagtaagattctgtctttgtaaaagtagttcgtagcagaagccaggatagtttggtaattaaacgcccaaactaaactcctcattcctacccttaatatttcctggctgtatgatcttggccaggtcactctctaaaagccccggtttcttcattattatcattattataatggggagaataacagctatacctgaggtttgttttgtgattaaattaaatgagacccaagtgc

SEQ ID NO: 40082 - DNA, 2482 bp, Homo sapiens
attcttgtttcgtactgaggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagcactgtaattcttgcacatccaaggatggcaggaaatggaaccattgctttctctgtaaaaagtgtgtaaagccttcctggatccactgtagcatctgcaatcactgtgctgttccagatcattcttgtgagggccccaaacatggctgctttatttgtggtgaactggatcataaacgcagtacttgtcctaacattgctacatctaagagagctaacaaagctgtcagaaagcagaagcaaagaaaaagtaataagatgaaaatggagaccacgaaaggacaatccatgaatcatacatctgctacaaggagaaagaaaaggagggaaagagcccatcaatatcttggctcttaaatgtccagtgactggagaataagaaagatttatggtccaacctttgatgccattttctgaaagtgccacactggacttaaattcagctgcttccagaggtgtgcacctttctgagctagataacaggcaggtggcatttgctggtttacagtcccttatctgcctctctggagacttggggagttgttccatcttcagccagtttactagttctttcagcattcatttttcctcactttaagtctctcccagtcacattgttctatttttatgttttcattttttttgagatggagtcttgctctgtctcccaggctagagtgcaatggcacaacctcagctcactgcaacctctgcctcccgggttcaagcaattctcctgccttagcctcctgagtagctggaattataggcacatgccaccacgactggctaatttttgtatttttagtagagacggggtttcaccatgttggccaggctggtctcgaactcctggcctcaagtgatttgcctgccttggcctcccaaagtgctgggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaaatatttattcttcaagtactttttgcagttgtcctctgacggtctagaatcacttaaatgcttgttgaatgagtgagatgtttagaactacgacttgctctgtcattccagtgtcgtttaacctatgcagtaagattctgtctttgtaaaagtagttcgtagcagaagccaggatagtttggtaattaaacgcccaaactaaactcctcattcctacccttaatatttcctggctgtatgatcttggccaggtcactctctaaaagccccggtttcttcattattatcattattataatggggagaataacagctatacctgaggtttgttttgtgattaaattaaatgagacccaagtgc

SEQ ID NO: 40083 - DNA, 2399 bp, Homo sapiens
attcttgtttcgtactgaggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccaggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagcactgtaattcttgcacatccaaggatggcaggaaatggaaccattgctttctctgtaaaaagtgtgtaaagccttcctggatccactgtagcatctgcaatcactgtgctgttccagatcattcttgtgagggccccaaacatggctgctttatttgtggtgaactggatcataaacgcagtacttgtcctaacattgctacatctaagagagctaacaagtcagtcgaatactttactagaaaaatgtattccatctgtgttttatacaggataatccacaaaagcatgcaacattcagaggatcttgaagtgccaagttaattgtcactttcactattaagtactggctgcatagatggatggagggaggagaggaagatgattcaaagagcttgctttcaaagagcttacagttctacagcttagagatgaaaataaccaaaatatgaggtagaaagtggttaattttacctctccttggctttacgtctcatgtgtaaagttatagggggtgacagttcatgctttattgaaggacatgatatttacgtcaggctttgagggacagatcagatatagacacatgatggcaggaaaggctggagaaggcatttcagattgaatagcaagtaattccacagtaggaaaattgtgagaaagctatttctttgtatcaaattttaagaaaaatatttagacatgcttaatgcttaaatatttgaaatttttattactttttttcctgtgattattttcacatctctcaccaatatttgattggagctatggattacaactcagagtatggggatacctatgacaatagcttatttagaagaggcactgcttctggaatagttatccccaaaacaaaacaaaaagagaaaaacattgctattttaaccgagctaatttgaatgattatacttttttcctaactaaaagggatgatagtgattaagtcctcttcctttattgctaagaaaactaatgttacacagttattaattggagattaccagacagctaaatttgacattatatgaaattatatgacattatatgaaaattcagattgggctaccatgtgactatgacttgtaatttaaaaaaattgatttgtgttagaaatatctgatagtttaataattatttatggtaatattaga

SEQ ID NO: 40084 - DNA, 1135 bp, Homo sapiens
attcttgtttcgtactgaggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccagggcatatagaaaagtaaatcacctttgtggttggtgaaatgccatgcacactttactgcatcactcttgggatgtcaggagt

SEQ ID NO: 40085 - DNA, 1504 bp, Homo sapiens
gagactgaggatttatgcttgcaatacagtagattctttcccttcttctattttcttatttggttagctagttaattaaacttcaacataattacataattcactgtgctcattctgtgaaataatttagcaccttgttttccagagctgtcagaaagcagaagcaaagaaaaagtaataagatgaaaatggagaccacgaaaggacaatccatgaatcatacatctgctacaaggagaaagaaaaggagggaaagagcccatcaatatcttggctcttaaatgtccagtgactggagaataagaaagatttatggtccaacctttgatgccattttctgaaagtgccacactggacttaaattcagctgcttccagaggtgtgcacctttctgagctagataacaggcaggtggcatttgctggtttacagtcccttatctgcctctctggagacttggggagttgttccatcttcagccagtttactagttctttcagcattcatttttcctcactttaagtctctcccagtcacattgttctatttttatgttttcattttttttgagatggagtcttgctctgtctcccaggctagagtgcaatggcacaacctcagctcactgcaacctctgcctcccgggttcaagcaattctcctgccttagcctcctgagtagctggaattataggcacatgccaccacgactggctaatttttgtatttttagtagagacggggtttcaccatgttggccaggctggtctcgaactcctggcctcaagtgatttgcctgccttggcctcccaaagtgctgggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaaatatttattcttcaagtactttttgcagttgtcctctgacggtctagaatcacttaaatgcttgttgaatgagtgagatgtttagaactacgacttgctctgtcattccagtgtcgtttaacctatgcagtaagattctgtctttgtaaaagtagttcgtagcagaagccaggatagtttggtaattaaacgcccaaactaaactcctcattcctacccttaatatttcctggctgtatgatcttggccaggtcactctctaaaagccccggtttcttcattattatcattattataatggggagaataacagctatacctgaggtttgttttgtgattaaattaaatgagacccaagtgc

SEQ ID NO: 40086 - DNA, 876 bp, Homo sapiens
  misc_feature (93)..(93): n is a, c, g, or t
  misc_feature (121)..(121): n is a, c, g, or t
  misc_feature (123)..(123): n is a, c, g, or t
  misc_feature (140)..(140): n is a, c, g, or t
tacttaacattttaactaacctaaatacaacagcccactctgtgtggcccctctggtaccgccgatttcaggatcaagaccaaagttctcatngtggctctggaggccccgcaagatcttnanatccctttttcttattnccaatgacaagattttaagagcaaatcagaaacccatcacacacaggaaagggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaaatatttattcttcaagtactttttgcagttgtcctctgacggtctagaatcacttaaatgcttgttgaatgagtgagatgtttagaactacgacttgctctgtcattccagtgtcgtttaacctatgcagtaagattctgtctttgtaaaagtagttcgtagcagaagccaggatagtttggtaattaaacgcccaaactaaactcctcattcctacccttaatatttcctggctgtatgatcttggccaggtcactctctaaaagccccggtttcttcattattatcattattataatggggagaataacagctatacctgaggtttgttttgtgattaaattaaatgagacccaagtgc

SEQ ID NO: 40087 - DNA, 995 bp, Homo sapiens
attcttgtttcgtactgaggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaaggtgtataatttattactgcaaaataaatacatatctatatatc

SEQ ID NO: 40088 - DNA, 2713 bp, Homo sapiens
attcttgtttcgtactgaggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccaggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagcactgtaattcttgcacatccaaggatggcaggaaatggaaccattgctttctctgtaaaaagtgtgtaaagccttcctggatccactgtagcatctgcaatcactgtgctgttccagatcattcttagctgtcagaaagcagaagcaaagaaaaagtaataagatgaaaatggagaccacgaaaggacaatccatgaatcatacatctgctacaaggagaaagaaaaggagggaaagagcccatcaatatcttggctcttaaatgtccagtgactggagaataagaaagatttatggtccaacctttgatgccattttctgaaagtgccacactggacttaaattcagctgcttccagaggtgtgcacctttctgagctagataacaggcaggtggcatttgctggtttacagtcccttatctgcctctctggagacttggggagttgttccatcttcagccagtttactagttctttcagcattcatttttcctcactttaagtctctcccagtcacattgttctatttttatgttttcattttttttgagatggagtcttgctctgtctcccaggctagagtgcaatggcacaacctcagctcactgcaacctctgcctcccgggttcaagcaattctcctgccttagcctcctgagtagctggaattataggcacatgccaccacgactggctaatttttgtatttttagtagagacggggtttcaccatgttggccaggctggtctcgaactcctggcctcaagtgatttgcctgccttggcctcccaaagtgctgggattacaggcatgagccacctcacccagctccggtcacattattctagcctttttatccaaaaaatgggcagaccattcttttgcagaagatgtcagaagaaaatgaaagtgaaaacctatgcagtttgtttaccgtgaacataaaagtatgttaatttaaataggaaaatattttatgttaaatatgaaacaatagtttaaaccccacttgaaaagtatagcgtacaattatttttagactgaatttgaagatgatggaaagggtttttacaaaggcactgtttagatatacagattataattataattacattattattaaatatttattcttcaagtactttttgcagttgtcctctgacggtctagaatcacttaaatgcttgttgaatgagtgagatgtttagaactacgacttgctctgtcattccagtgtcgtttaacctatgcagtaagattctgtctttgtaaaagtagttcgtagcagaagccaggatagtttggtaattaaacgcccaaactaaactcctcattcctacccttaatatttcctggctgtatgatcttggccaggtcactctctaaaagccccggtttcttcattattatcattattataatggggagaataacagctatacctgaggtttgttttgtgattaaattaaatgagacccaagtgc

SEQ ID NO: 40089 - DNA, 2096 bp, Homo sapiens
attcttgtttcgtactgaggctttcgggacggcggcgggaagatggcggcctccaggaatgggtttgaagccgtggaggcagagggcagcgcagggtgccggggaagctcgggaatggaggtggtgcttcctttggatcctgccgtccccgccccgctgtgccctcacggacccactcttctgtttgtaaaggtgacccaagggaaagaagaaactcggaggttttatgcctgttcagcctgtagagatagaaaagactgtaatttttttcagtgggaagatgaaaagttgtcaggagctagacttgctgcccgagaagctcataaccgaagatgtcagcctcccctgtcccgaacgcagtgtgtggaaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggttgcatgagctgatcaagttgacagcatcaggtgacaagaagtctaacattaaaagccttttattggatattgattttcggtattcacagttttatatggaagatagcttttgccattataatatgtttaaccatcatttctttgatggaaagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaagatgacagtcacaaagaactacccattttctggattttcccctatttttttgaatcccgaatttgtcagttttttccaagcttccagatgctggattaccaggtagattatgataatcatgcactttataaacacggaaagacaggtcgaaaacagtctcccgtgcgtattttcaccaacattccgcccaacaaaataatccttcctactgaagaagggtacagattttgctctccgtgtcaacggtatgtttctctagagaatcaacactgtgagcactgtaattcttgcacatccaaggatggcaggaaatggaaccattgctttctctgtaaaaagtgtgtaaagccttcctggatccactgtagcatctgcaatcactgtgctgttccagatcattcttgtgagggccccaaacatggctgctttatttgtggtgaactggatcataaacgcagtacttgtcctaacattgctacatctaagagagctaacaagtcagtcgaatactttactagaaaaatgtattccatctgtgttttatacaggataatccacaaaagcatgcaacattcagaggatcttgaagtgccaagttaattgtcactttcactattaagtactggctgcatagatggatggagggaggagaggaagatgattcaaagagcttgctttcaaagagcttacagttctacagcttagagatgaaaataaccaaaatatgaggtagaaagtggttaattttacctctccttggctttacgtctcatgtgtaaagttatagggggtgacagttcatgctttattgaaggacatgatatttacgtcaggctttgagggacagatcagatatagacacatgatggcaggaaaggctggagaaggcatttcagattgaatagcaagtaattccacagtaggaaaattgtgagaaagctatttctttgtatcaaattttaagaaaaatatttagacatgcttaatgcttaaatatttgaaatttttattactttttttcctgtgattattttcacatctctcaccaatatttgattggagctatggattacaactcagagtatggggatacctattccagaatcagtgcctcttctaaataagctattgtcataggtcgacgc

SEQ ID NO: 40090 - DNA, 367 bp, Homo sapiens
atgaaaaatatttcagtggccagaatcctttcaatgacttaaaaagcccttttcatcctgcttctgcctacctctccagctgcatcttagtacccgcacactcttttttcatactcatgcccctgcttgctgtctttgcacaggtattctctttgtctggagctttcttcctcaccaatcatctcctaataactcccattttatcttttaaatgttgccactattatcacttccttggaggagccttcttggactgcctatttcaaatcccctgggttttttttttttctttgacaaaagccacattcgaacaaatcccccttggaatgttacaattaccaaaaaatccaatttaaactagtttaaa

SEQ ID NO: 40091 - DNA, 439 bp, Homo sapiens
gaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcatttt

SEQ ID NO: 40092 - DNA, 495 bp, Homo sapiens
agattcattcattcatttgatacttattaaaaacatactttgagccaaactttatgtagagtgacatagattcagaagaacaaaaagctcatattttcccttgcaaaactactccagtaaggaagattatgatcaaaaaagaaattattatagaatgacatgccttggcttagcatttgttttcaaaaaggctttctagaacagttgcctttaaattgagacatggagtatgcatagaaattaatgaagccagaagttggtggaaatgtgatccaggcaatccagttctttgagctgcctatcacatgaaatacttttgtattccttcaccagagagctaaatatgtccttcagtagcatatctgtccccttactaaagtgcacaactctaggtatgtactaaccagagcagagtggagcaggtctcatcacctgtcctcctcattatgtactttatatggcttttaatatgaagaagagcctgggcaacatggc

SEQ ID NO: 40093 - DNA, 1023 bp, Homo sapiens
agagctctgtcatcttctgacagaggagcagcagcagagatggtaacatgtttcagattgggaaaatgaggtacgttagtgttcgcgattttaaaggcaaagtgctaattgatattagagaatattggatggatcctgaaggtgaaatgaaaccaggaagaaaaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcatttcctttaataacttaatctcctcatgttcagttttacttcactctttattctttctgatatggatgctattggaagtccgtggactgtcaaaggtgtcttctagtctttttggactccatcccgatcttggtcatatttgcgtcctgtaccctgtggtggacggcgcgtggtccttgcgtggttggcgccggaaatggcttggtggcggggcctaatgcagaggggcatggccgtttggggaaaaagggcgcttcttgggggtttgtgttcgcgccgccttttgcgggggggta

SEQ ID NO: 40094 - DNA, 316 bp, Homo sapiens
aaatcactagtattcctatacatcaacaacagccatgccaagaaccaaatcagaaagcaatctcattcacaattgctaccaaaataataaaatgcctaggaatgcagctaatcaatgaggtgcaagatctctacaaggagaactacaaaccactgctcaaagaaattaggaaagacacaaacaaatggaaaagcatctgatgctcaaggatagaaagaatcaatatcactgtaatggctatactgcccaaagcaatttacagatccaatgctcctcctctcaaactgcctatcattgaaattattcatagaactag

SEQ ID NO: 40095 - DNA, 374 bp, Homo sapiens
ttcctatcaaaatcctaaattttgtttaacagaaatgggaaaaatttattctcacattcatatggaatctcaaaggacatgaaataaccaaaacaaattttaaaaagaaagtcggaggtctcactacctgatttcaaaacctcctacaaagcataaagctagacatagagattcatgaaaatagacccgagggcccacaaataaacccttgcatatattttcaagtgattttcaccaaaggtgccaagaagtaccaaagatcctcattcagtaaagaaaggactcttcaacaaacggtattgggaaaattggatatccacaccagaaaagaacaaagttggatccttaccatacaccatatacaaaaagtaact

SEQ ID NO: 40096 - DNA, 256 bp, Homo sapiens
tattccctgttttggctcacgatatcttccattaactcttacatccctgctgtgagctcctgttttatataacagtaacttcattgagttccttttttcttaaagtttattggcagtatgttctgacacagcatccattgctatatgacaacttttattctctgaaaagagttcttcacctgccatttctttttcccatttcttagttttgtttggtttttaaatactatctttacatagatctaatgctgttttt

SEQ ID NO: 40097 - DNA, 363 bp, Homo sapiens
gagccgggtggacactgggtgcctgcgatacgcaagaccctgggacagacctgatcccccgccagcccactttatacctaggttccttccaaggccgttctcaatgggtcctacaagtcattatgtgtacctggaatttgaacacgagaaacaagctactttggtcctctagggcaggaggaggatggccctgaacgtccttacctttagctctgtgatcttcctccttggggcacttccctccttcccaccatttgcgcttcaggatctccaggcggttgttctcctgcagctggagaatggccagatcaaactcgtcccggaaaaccgagcctgcgggggttacgggagagcccaggacac

SEQ ID NO: 40098 - DNA, 550 bp, Homo sapiens
agagaaaaccaggcagggcacttagtgcagccgctggtggaggcagtggttagagttcactcgctagagggtccttgtgataagagggtccttatgataagagggtccttatgataagagggtccttatcatggccattttcctttgatccagatgtctttaaatatcagaaaaataacgcttttagtcccaaccgccacatcggaatcagttcttattccttctggctacaatgtccaacataagttgaacaacataatttggacaacagaaggaagggttgtcatgctagccggagatgacttctagttaagaggtctgagcatttccacgcacaaccagttattctcaacggagggcggactctccatacgaaacaagcagagccctggcagagactgcagggcatttgtaaaactcaaacaccacgttgatctcactgccacgttctttccagttacacgcaggtctaacatgctggcataagacattgtcttaatcagaacacttttaaagcttttttttcccttttttccaattcaaaaaaaaa

SEQ ID NO: 40099 - DNA, 896 bp, Homo sapiens
cagcggcgagcgcagcgggggcggcgggccggggaccgggcagcaccgggcgcgcggagcgggcgcgccgccaacgcggtcacgtgcgcggcccctcctctcgcgccggcctcccccgcgccgcgctctccattcataaattctccgcctgctccgcggccaccgggcgccggagccagccgcgagcgccacgcagccgcccgccgccagcccgccgcccatgggccgctcgtcccggcgctgagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccaggtg

SEQ ID NO: 40100 - DNA, 1245 bp, Homo sapiens
ccaccagcactcagcaccggggagacctccacctcccggagtcgtgacccgggagcacgcgcccagcccctgcaccctccctggcgcgcaggcagcgggaggtctccctctacccaaccatggccgggtgggccctgccagggtgtagctgaacttcttggggtgggggtagccccccacccccgtgatggggcggacagggcgtctggagtccttctcgagccggctgcaccgccttggcgtccccattcctccgagtgcttgccctgcccagcgctgagctccagggcctggcgctaccttgcaggacaggccgcaccggctgtgtgcagttgtgatgggtacaggcgcaccctcagagggccaggcctcctcccccgccatggggatgggagatggaggtccagagagagcccccggggcccgctgggcagagccaagccgggtggaggctgcctccggctctgctacctctccatgagtcactgccccctgtgtgggctcctgctcctgcagggaagacccagcttgtctgcagtggctcctgcaggagaagtaggtctagctggagctgaccaggcttcctccccacagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccaggtg

SEQ ID NO: 40101 - DNA, 770 bp, Homo sapiens
ttgaaatccctacacagaaccagatcatttggagagctatacaatgatggcaaggagatcctagaaaatactgcaaagggagatgacaacacttatattaccatagtggctttgggtggggagaaatattttgtgtaaaaggcagctttcaagtgggtttggtatttattttagttacatggtatgagtaccttcaagctgagaaattaactgaataactggttacaaattggcagtatttttgtgaggccagaaagaaacaaacagaagcaaaacatttctaaagaattcacctaaaacccagactacacaagatttctataggtaaaacacttcttaaaatgaacttgtcttccaaaatacaaaactcaagaaggaacaatcttccacgcacaaatgttagcagaagaagagatagaattatcagctcaaatttccaaataaggataagatgtcaaagcaggaaatgaaaacgggataaaagaaaatatgtatatatgtttttaaaatatactttagaaaacaaagtagaattgaagacgtgaaaaaaaacattaaaaataaaaatcattgaaagggttaaacgtcagactgaacacaactgaagagagaatttgttaactggataatggatttgaagaagttacccagaatgcacgagaggagagaggaggagagcagagaggggagagaggaggagagcagagaggagagagaagatgcaagaggactgaagggctgacataaaatctactaagagggccagacag

SEQ ID NO: 40102 - DNA, 309 bp, Homo sapiens
atcagtgatagctgccctaagaagcttttttgcatgtttctcagcatttaatcattttaggacttcgctacagaacttctctaatcccatcctctttatgttcactcatgcatgtactttttatctggccgtttttttgcctcactggatcttaattttctcagtccttcattaattcgttcgacaaatatttactgagcacctacgctatgcaaaggtactgttctaggctctcagtgcacagtgttgaacaagacagaacagcttttaccctcataaaaagtttactgtagtggggagaaagacaaa

SEQ ID NO: 40103 - DNA, 793 bp, Homo sapiens
agtttggaggttcctcaaaaaacaaaataggctgggattacaggcgtgacacacacacccggcgacttcatccactgtctgtccgcttcctgtgtaaggccgaccacccagcccccaaacaacccttaaaatgagacccaaaccaaagacctaacatataagcctcaaatcagtaaacctctcctgaaacaggcagaggaactgcctgcccagaaatactcacaataggctgtgcagattgtaaagagatcaacagcttcacccacgctctgcataaactctggtactggctgtgttctccatagaaggtctcgctgtgttgcctggggctggagtgcagtggtgtgaacacaggttcactgcagccttgatctcttggggcttaagtgatttttcctggcctcaggactccttgagttagctgaggaccacaggtggcattttcaccactcagctaattttttagtttttttttgtaggagatgaggtctctaccaagctggtctctaactcctgggctcaagcgatcttcccatcttggcctcccaaagtgctgggattacacatgtgaaccactatgcttggctcaaagatttattgataataccctgcaagcacaagcgtgcaaagcaaaaatggacaaataggatcacatcaagttaaaaagctgcacagcaaaggaaacaataaacaaagtgaggaaacaaccacagaatgggagaaaatatttgcaaaccacccatctgacaagggattaattaccagaatatataaggagctcaaacaactctat

SEQ ID NO: 40104 - DNA, 273 bp, Homo sapiens
ttttttaaattgtggtagaatgtgtataacacggaatttgtgattttactctctcttcacgagatctacagtttttagctccacttgagtgagaacgtgtgacagttgtatttctgttcctagcttatttcacttaacataatgacctctagttccacccatgttgctgcaaatgacaagattcatttttttatggccaagtagtaataaattgtgtatatataccacaattttctttattcaactattaatgaatataggttgattccatat

SEQ ID NO: 40105 - DNA, 611 bp, Homo sapiens
tttttaataaaataaataagcaaattcctgtattcagttttcacaatctctctaacatagtcaaatccacaacctcatactaaagaatgtttttggaaagcacttgatgtccctctctgggctgacagtctactgactgtctaaatgagactcagaaatctgaaagcttggttttcattagctccaaactatcagttcctaaaaaggcttagaggacatggaagacaaaagtggctatcctttgctaggaattatcagaataagtacctaaattaatctctccaggattttttgttttctcttcagcatatgcccaaggtatgtatgatgtgagcagcctgaagctattctgaatgacaaggactagttttaggtaacctccaattgaattgtttttatttttcctatggagatccagagacgtttgttttcaaatggagcaaacagcactgtgatactgactttgtttattaaaaaataattgtttccaaattaatttcaactcataatgagttaaagcgattagaaataaagatagtatctccaaaaaaaaaaaaaaaatactataaggctacagtaaccatcgagatggtccgagctcggattcgtct

SEQ ID NO: 40106 - DNA, 1059 bp, Homo sapiens
ggtcgaccaggtgcctgccaccatgcccggctaatgtttgtattatttagtagagacagggttttgccatgttggccaggctggtctccaactcctgacctcaggtgattccccctgccttggccttccaaaatgccgggattacaggcgtgaccatggcgcccagcccttcctcccatttttgctacccacctgtcacttcttgacattgtgattatttatgtcatactgtttctgatctgttctgggcctgggaatcaaatagccatgtttgctaggcctttgtatgagatgctgcattttgactgaggcctcaggactcccgggtgaaaggtgggtatatacaaaagtgacattgcgtggtttgacaccttttgattccttcctgctttttctttattgcataattgatacattgcttgaatgctagattccccccatctacccccacatctcatttaacaaagaagtatagaaacatcctggggagacagtgtggagtggacctgggagtctagcatatgtgagttctagtccccgttctgccacttcctgccttctgtgatgctgggctagctacttgacatctctctcctagcttctgttctgtagaatgggggaaaacaatagttgccacccccagacaccatgttgtggagatgtgtctggcttatactcaactcagtgactgtattgtagctattagctcttagtaacagaaaattagtttttagtattatatttctaagatttgtatgtccctgcctctttaagtatttggtttgtattaataccttttggtcttgttatataatattctagctgtaaaagcatttcatcaatgaattgaggaagtctctgattttaaatactttaatcagtaaaatttcagagaaaaatctttaagacatttgattggtaagatgataatacatggcagaacacacaagcttactttttttaataggcaagaagatgtgtgaaaacagccttaaaaaaaaaaagcctaagaattccagtctttcagcctggaatatgaacaaagtttctttaataaca

SEQ ID NO: 40107 - DNA, 388 bp, Homo sapiens
attgccttcagcctgtgtgcaatttagcagcaagatatttcatatctcacagcattcactagtcctactcaattaggaactgcttgcaaatcagaacagctgatgatcataatgactcaagtggacatgtttgccctgaaaaggaaaagaaaatattgaaaagacatttcaattgtcattgaataactcagaaagggaccagggtgttgtcaggggaaatatattgtcattggccttcctgactgcggaacttccctataggttatgacaatacagctgggacacaccagaagggccaatgtgagaaataagaacttgaaactggggccgcctgtctttctgggggtggtctcctgtcccatttttagttatacccatattcccaggc

SEQ ID NO: 40108 - DNA, 380 bp, Homo sapiens
tcttttttttttttttgagatggagtctcgctctgtcaccaggctggagtgcagtggcgcgatcttggctcactgcaagctccacctcccaggttcacgccattctcctgcctcagcctcccgagtagctgggactacaggtgcccgccaccacgcccagctaattttttgtattttttagtagagacggggtttcaccgtgttagccaggtgaaagccaggtcaggaggatctcctgacctcgtgatccgcctgcctcggcctcccaaaatgctgagactacaggcgtgagccaccgcgcccggccacagtgtgatatttcaatacgtgtatgtaatgtgtaataatcaaaccagctaattagcatatccatcacctcg

SEQ ID NO: 40109 - DNA, 241 bp, Homo sapiens
tcatagcaaatcaccatttattgagtattttcttatgtcccagacactgcattgaaacccacctcatgtcatcattttcattatggctcaataggcataaatttccccttgcaaatgaggaaacagaggcccaaggaagttaagttaacatgtccaagatcaaacaactaacttcaaaactggggtccaaaagaagaacagttctctgattctgagggcaacgttctctttgctaaataac

SEQ ID NO: 40110 - DNA, 287 bp, Homo sapiens
tttttcattttgggcggggtggtttatgctctgaattaaccatgagctccactttagagaacttgaaaaaattgactttttagaatatttttggcagaatatacaaattgcttgataaactgcaaaagattgagtaatttttcaaaacacccagactgcacctgttagatcattattatttcagaaattccatattgtacattgaaaataacctcacaagtatattttctgtatttatggccaagagctggtcattggagatttatgatgctctgcaaaaaacaatg

SEQ ID NO: 40111 - DNA, 433 bp, Homo sapiens
agagggggacaacacacacctgttgggtggtgggggtgaggggagggaaagtggaggatgggtcaattggtagagcaaaccaccatggcacacatatacttatgtaacaaacgtgcacgttctgcacatgtatcctttttatttttaagaagaaataaagaaaagaaagaaaaatcctaacaccagaaaaaaaaagtgaaataaaataaaatgaacaaaagatcagaataggtatgtcttttcaaaagacacaaaaacggcacatacatgaaaaggttctcaacattatcaatcatcaggaaaatgtaaattaaaagcactatgatataccacctcatactcattcggatggctattatcaaaaaatacacacacaaacacacacacagagatagagagaaagagagagagagagcgagacatagatagagag

SEQ ID NO: 40112 - DNA, 480 bp, Homo sapiens
gatcattatttttcagaagcctgataatcttgtcagtatcattccagtttcagggtgtgtttgcccagaaaagcactcggtaacttttttacaacataagtaggttaggttgtatccttgctagaaatatgtataatgagctgtgatccatccccgctttcttagtgccagtaaacactctggttgtctagcaaaagacagctcttatctcttgttgttgttgtcatttcagtttgtcacagggactgtgctcaattggatgttattgtacgccacagtaggtcttgctattcactgtgcaataactgtactaaactttgacatgtacacttttatttttatttacttatttaagacagggttttgctctgtcatctgggctggagtgcagtggtgcaattatagctcactgcagccttgaactcctgggctcaagtgattctcctgcctcagtccacaggtagctgggagtacagacac

SEQ ID NO: 40113 - DNA, 630 bp, Homo sapiens
gtgtggcaaaagtgcccaatataagaccaacttacaaaatcaaaagcttccctttacattaaaaataaatatatgtaagacaaaataggaaaaaagagatcttatttatgatatcaacaaatctacacaatacctatacataagcttaacaaaaattttccaacagccacgtggaaaaaaaaatctaaaactagactaaaggacataaaaatgaccttattaaaagaagaggcctgccatgtacatgaataggcaaacagtttattatgaaaatataagttcttcccaaactgacctgtacttcagtgtaatacaaactgagatctcaatggattattgtgtagcttaaaattggattctgtaattcatctgaagagaaaatagggaatgataacctagaaacctttgagaaaagaatggtaccaaaagaaaatgatttggagaaagtcaccaagacaattcaatagaaaaaagagtaggtgtttcaacaaatggttctggaacaactagctgtccacatgccgaagaatgaagttggacttgtacttcaagctacatacaaaaattaattcaagatggctaaatttgtaaatataatagctaaacccatacaactcttaaaaagaaaaa

SEQ ID NO: 40114 - DNA, 455 bp, Homo sapiens
cgttgccagaactccagggcttagctcaggccctacaggtgtggtctgtctgcctgcaatgacccaggagctccctgagggcagggctgggtcttcatctccccactgtctggcatcatcctagcagggatggagctcaacacatagcccagccgaagtcccccagatgaatgagcaaaccctgagtcttggttgaggcttggttcatgcagcaggctcgtgccttggccctgggaaagctcccagatgagttgggctgggcagaggtgcagggccctcagcctctggcttaccccactctcttccactttactccactccactctcatctcctcgatccaccccacctctgctagttagcgaagctccttggagattcctcttgaattttcattaatttctattgaataattaaaaccaggaaattaatactttcatcctaaacctgaattgca

SEQ ID NO: 40115 - DNA, 1569 bp, Homo sapiens
ccacgcgtcgaaaaagggcggccgtcacgatctagaactagcttgaatccaggaagcagaggttgcggtgagccgaaaatgcaccactgcactccagcatgggcaacacagtgagactgttgtctcaaaaaaaataaatgaataggccgcgctcccgcccagggaggatgcgccgacgccccgagcgcccggccctccgcagcagcccggcagactgcctctgtcatcaggaccctccgtccacgtcccctgtgcggccagcgtcagagccatggcgatggaggagaggaagcccgagaccgaggcaacgagagcacagccgaccccttcgtcatccaccactcagagcaagcctacgcccgtgaagccaaactatgctctctaaagttcacccttgctggccacaccaaagcagtgtcctccgtgaaattcagcccgaatggagagtggctgatgacaaaaccttgaagatacgggacgtgagctcgggaaagtgtctgaaaaccctgaagggacacagtaattatgtcttttgctgtaacttcaatccccagtccagccttactgtctcaggatcctttgatgaaagtgtgaggatatgggttgtgaaaacagggaagtgccacaagactgctagctcactccgatccagtctcggccattcattttaatcgtgatggattcttgatagtttcaagtagctatgatggtctctgtcacatctgggacaccgcctcaggccagtgcctgaaaacgctcactgatgatgacaacccctggtgtctttcgtgaagctctccccgaagggtggatacatcgtggctgccacgctgggcaacactcaagctctgggactacagcaaggggaagtgcctgaagacatacactggccacaagaacgagaaatactgcatatttgctaatttctctgttactggcgggaagtggattgtgtctggctcggaggataaccttctttacatctggaaacttcagacgaaagagattgtacagaaattagaaggccacacagatgttgtgacctcaacagcttgtcacccaacagaaaacatcatcacctctgccgcgctagaaaatgacaaaacaattaaactgtggaagagtgactgttaagtccctttgctcccacatgcgatagaccgtcaggaagttgacccggattggcaagaaacatgatgtctcggaggcggtcccctgggtctgtgcctgggggtcaggaccgggcctgatttgagcctcctttttgaagatgatttggccgagtgtggaccaccggaaagttctaaaagttgctggtgacatttcttgccaattctctaacactgtctagggaagagttcctagtctgttgtgttcaaacagagtcaacaaaaatttttaattttttgttacaaaagggtgaagttcaattttaaaaataaataataaatataataaaaatctcatggaacttcaatgtaaaataattaaaatggcattttattagcagtgtatgttaaagtttcagatttgtaacatttactctgtaaataaaaatagggaataagt

SEQ ID NO: 40116 - DNA, 1215 bp, Homo sapiens
gtattgatgggaaatttgagaaaaccatatctggtcacaagctgggaatatccgatgtagcctggtcgtcagattctaacctttttgtttccgcctcagatgacaaaaccttgaagatacgggacgtgagctcgggaaagtgtctgaaaaccctgaagggacacagtaattatgtcttttgctgtaacttcaatccccagtccagccttactgtctcaggatcctttgatgaaagtgtgaggatatgggttgtgaaaacagggaagtgccacaagactgctagctcactccgatccagtctcggccattcattttaatcgtgatggattcttgatagtttcaagtagctatgatggtctctgtcacatctgggacaccgcctcaggccagtgcctgaaaacgctcactgatgatgacaacccctggtgtctttcgtgaagctctccccgaagggtggatacatcgtggctgccacgctgggcaacactcaagctctgggactacagcaaggggaagtgcctgaagacatacactggccacaagaacgagaaatactgcatatttgctaatttctctgttactggcgggaagtggattgtgtctggctcggaggataaccttctttacatctggaaacttcagacgaaagagattgtacagaaattagaaggccacacagatgttgtgacctcaacagcttgtcacccaacagaaaacatcatcacctctgccgcgctagaaaatgacaaaacaattaaactgtggaagagtgactgttaagtccctttgctcccacatgcgatagaccgtcaggaagttgacccggattggcaagaaacatgatgtctcggaggcggtcccctgggtctgtgcctgggggtcaggaccgggcctgatttgagcctcctttttgaagatgatttggccgagtgtggaccaccggaaagttctaaaagttgctggtgacatttcttgccaattctctaacactgtctagggaagagttcctagtctgttgtgttcaaacagagtcaacaaaaatttttaattttttgttacaaaagggtgaagttcaattttaaaaataaataataaatataataaaaatctcatggaacttcaatgtaaaataattaaaatggcattttattagcagtgtatgttaaagtttcagatttgtaacatttactctgtaaataaaaatagggaataagt

SEQ ID NO: 40117 - DNA, 173 bp, Homo sapiens
agtggtttccttaaaagtcagtgttggaaataagagctcggagtcgcaggaaaaacaagcactcaaacaataggtttctcagcaaagcaagtttacttctacagaaggctgccgctcatgcttctggccgctgcgagcacaactaacaaaggagaggagtttttatccctaac

SEQ ID NO: 40118 - DNA, 415 bp, Homo sapiens
aaatttctttaaaatatttaacatttttagatatcacacagcaatatgatgggtttaaacctattaataattatgccaacaaatacattaaatgtaaatggaaaaacagttctatcaaaacataaaaattgtcagataagattttaaaacaacattaggggccgggcacaatggttcacgcctataatcccagcactttgggaggccaaggtgagtggatcacgaggtcaagagttcaagaccagcctggccaagatagtgaaactcagtctctactagaaatacaaaaaaattacccgggcgtggtggcgggtgcctgtaatcccagctactcaggaggccgaggcaggagaattacatgaacctgtgcggcagaggttgcagtgagccaagatcgcgccactgcactccagcc

SEQ ID NO: 40119 - DNA, 149 bp, Homo sapiens
ctcagtgtctcatcttgttctttcagactgactctggagatggctgagctaataatgtgtgatcctatttattggggagatttctcaggtccttcttcctcttcttttgcctgctgccttggacataccaggttggacaccagtcctat

SEQ ID NO: 40120 - DNA, 285 bp, Homo sapiens
ttgtgtttttaaatagagacaggtttttgccatgttggccaggctggtcttgaactcctgatctcaagcgatccacccatctcagcctcccaaagtgctgggattacaggcgtgagccaccgtgccaggccgatgttgcagtcttgagtctgaagggagactggagacagagttccttcttctttagggacttcaatctttttctcttaaggccttcaactgatgatatatgaggcctacatacattacaaaggataatctgcttcactccttctactgatataa

SEQ ID NO: 40121 - DNA, 1686 bp, Homo sapiens
ctcagctttagattctccctgtactggaaagggatgtcgcaaggttggggacgaaacctctgagtttgcgaccgtagctgtcgctttccggccaacacagaggtgcctgaaggctggttggggtggtgaggcccgaggcagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattgccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatcgtctgctttcctggggaccctgctgtcctctccctaagtgcttctgctttcagccggtggagagtctgatgtgcctagagaagttgcgcagtgggacgaggctgcagcgagagcctggcctttccccaggcggaagagagccttgtctcagatcctgagagagaagtgagtgggggcatggcattccgagcagcccaggtttggctttgggccaggcactgagtggcaaacaagaaggaacacattccgggaaggcaaggagccctgccagcacgaaggcagcagcgaaagcagggctctgctgggtaccaggtgttccttggctctgtggaggtcaggcacgcaggcggatgaactcaggtttctctagaatatcatttcagaggcttaaatgcctcccaccctctcgctgtcagcggacagggcatgtggaactgttaaacgttaaaactctctgctctggggcccagcccgtgctctctaaataaaggtaggagcgga

SEQ ID NO: 40122 - DNA, 1543 bp, Homo sapiens
ctcagctttagattctccctgtactggaaagggatgtcgcaaggttggggacgaaacctctgagtttgcgaccgtagctgtcgctttccggccaacacagaggtgcctgaaggctggttggggtggtgaggcccgaggcagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattgccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacgtctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggaaatctcagtttgctc

SEQ ID NO: 40123 - DNA, 1479 bp, Homo sapiens
ggtacggtccgccaagcccgtagatggccaacacagaggtgcctgaaggctggttggggtggtgaggcccgaggcagctcttgttcagcttctggaatttctgagcagccctcgtcagtacaagatggaccccgtagtcttgagttacatggacagtctactgcggcaatcagatgtctcactattggatccgccaagctggctcaatgaccatattattgggtttgcgtttgagtactttgccaacagtcagtttcatgactgctctgatcacgtcagtttcatcagccctgaagtcacccagttcatcaagtgcactagcaacccagcagagattgccatgttccttgaaccactggacctccccaacaagagagttgtatttttagccatcaatgataactccaaccaggcagctggaggaacccactggagtttattggtctacctccaagataaaaatagcttttttcattatgattcccatagcaggagcaactcagttcacgcaaagcaggtagcagagaaactggaggctttcttaggcagaaaaggagacaaactggcctttgtggaagagaaagcccctgcccaacaaaacagctatgactgtgggatgtacgtgatatgtaacactgaggccttgtgtcagaacttctttaggcaacagacagaatcactgctgcagctactcacccctgcatacatcacaaagaagaggggagaatggaaagatctcattgccacacttgctaaaaagtagctattgaagtatatttgcgacttttgaaggctcctctttctgcccttccccatttgttggatggctgcaatctcagtgcctgagggaagatgcctagtagaggaaagcttaatactctttttcctgaaagaatatcatcctctgcattatccccatggaacgtttcactttaaccctgactggggagcaatatgttctgtgaaaatatcttgaaattgtacaccaaaaccttacaaccaacttatttgaacatttattacacacagggtttacgtaagacttttcttattggtatataattaatttcctttggtctcccttatccacattggcttattctggaggaaaagcagtgatctgtaaaacaaatcaagaatatattaaatctagaggaatgcagagaagaaaactataaaacagaaccaaaaacttgttgcacagcctacataattaagagatcaactggctggaagcagatcaaggcctaacttcattcaagacctaaatattatgagactcagttattcggttttatgtgacgtctcttccattcaccatgcacaggcttttccagctatctatataatgtttgcaaatatttgataaagatgatgttaccctatcttcctccatctgattcctggaatgcttgaagaaaggggaaatcttgagtaacctcattaaaattaatgtctggtggaaatctcagtttgctc

SEQ ID NO: 40124 - DNA, 873 bp, Homo sapiens
gcgcgccatcttggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacct

SEQ ID NO: 40125 - DNA, 1604 bp, Homo sapiens
gcgcgccatcttggctccggatcgtgcgtgaggcggcttcggtgagagccggaaccgggcgggcagaggggcgctcgtagggttgggggacgcctgtggcttggctgcagcggccggcaagaccctggaagagaccgtggctatggaaacggccaaggctgtcttggaatgtcctgagcagccctccgagtcgagcctctgcccccgagtttctgagtgacctgggttgatatagattgaccttggtaatctctgggagaggggatccgttctgtttgggggcagcactggataagggttcttggctgtttcccggggggcctggggcgaagggccttgtccctgtccttgtagagccccaagtgaggagcgctctctattggtattagtctggggtgagggttccaggccctgttccaaggagcccaggataaggggggctaagccccagtcctggagagtttaggatgagggggcctggcactttcccaaagagctcagtgtttggggaatgtgatcctgcctcttggactccaggattggaggtgggggtgttatggcccttgtagaggaacggggtgtatggggtacagccctttcccagactgcggcaggcatggaccttgtcacgagatgctaaggacacggggacatgatcctgtttctgggaagtctggaacggggagcagggccatatcctggatggagataggggatggtggacagtgacttggggcacattgcttagcacttacctgatgcttccctgcagtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacct

SEQ ID NO: 40126 - DNA, 821 bp, Homo sapiens
gcgcgccatcttggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcatgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacct

SEQ ID NO: 40127 - DNA, 1077 bp, Homo sapiens
gcgcgccatcttggctccggatcgtgcgtgaggcggcttcggtgagagccggaaccgggcgggcagaggggcgctcgtagggttgggggacgcctgtggcttggctgcagcggccggcaagaccctggaagagaccgtggctatggaaacggccaaggctgtcttggaatgtcctgagcagccctccgagtcgagcctctgcccccgagtttctgagtgacctgggttgatatagattgaccttgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccaggcctgcaccagctcaccaagctacgtttccttcagactgaggacagctgggtcccagcctcacctgacacagggctagaccccctcacagtgcgccgccatgtgcctgcagtgtgggtgctgctcagccgggaccccctggaccccaatgagtgtggttaccaacccccaggagcaccccctggcctgggttccatgcccagctccagctgtggccctcgttcccgaagaagggctcgagacacccgatcgtgaagacctgctgagccagcctgttctccgggcctgaatgtctggggtgcttgtgccttttctgagaagcgttgtgactgctcaacatccccatcaaggtttgagtccacaaaagtggacctccctatcatgcttccccttccctctagcatgtgggaagggactgctgtgaagaatgacagatgtggggcctctgccaagttctgcattgctaaataagggcttcctctgccttctacctacagtgcatttgaactgccttctgaaagaggtccagggagggatttaggaaataaagtttctacct

SEQ ID NO: 40128 - DNA, 451 bp, Homo sapiens
cttctgagttcaagcgattctcccacctcagcctcccaagtagctgggactacaggcgtgccccaccacgcctggctaattttttgtattttttttagtagagatggtgtttcgccatgttggcccggctggtcttgaactcctgacctcaggtgatccacctgccttggcctcccagagtgctgggattacaggcgggagccaccgtgcccggccccagtggactgattctggtcagtgtcaaccccatttgtccctggagcttttgcagtcggtcacagggccagcccggtcctggtcaccgctggctggttaccccggctgggttgggcaggagtctgggcagggctggttgctcatctcaggtatgaaattggctgcacccccactagtgtgggggagcaggattccagggcctgcctggcgctgctacccctgtgcctccagaccc

SEQ ID NO: 40129 - DNA, 306 bp, Homo sapiens
gtgggcataagtcacctaagctgtggtctacccatgcatcaggacaccacgctcccaccatgagacggggcagctgagtacacactggtacatgaaaacagcaaggttaccaagaaagttctggtcaaaagagaaaggaaagcttctctgcccctatacacaggtctctgaaaggacatgcaggtgacggtcacgctggcccatctaggagaggctgtgtacctggggagggaggtgcagagatttctcagtgaacctctttggtggcttttgaaagcacgtgacactattaactccaaaaaaaaa

SEQ ID NO: 40130 - DNA, 1960 bp, Homo sapiens
gagaaaatggtggaataaggaatcccaaaagttcacccttctataaaagctagaaaaaaagtggcaataaccatcagaatgtgctttttcagaactctggaatgtaaccaaatacttgaagtactctgggaagcatttatttaaaaacaaaaacaaaaaaccttagtcaattcttaatgaaaaaagcaaaactgtggtgtcttaacttatctgaatcccatactccaatccccagctcagcagcagccttgaaataacaacccacattcccagtgcaggcatatgagggagcagaatggaccttatttacagaaaattctaatttgatctatctggtggctgccttgaagacatgctactagacacatgtttttatctctcctgactgagaacttgctttatactaagctgctcccaagggagcacggtctaaacattcttctctactgtctaaggcaatggataacaattgggggaaacaatagactagccaaaaaacttggaagcaaagtctagggaatgacatgctgtagggaataaggtctttgaaaaggtcctacatgttcttaagattttagaagaacattcacatgtccagggctgtgcacacactcaggaaaaatgcaggcaggccccagtctcttaactctggctggccattaggctacgcataatcaggaagtgaaggcaaaggctgagtagtaaactgcctggttgagtgttgaaggtatcctcccacccccacacacaatggacacagagccccttggctaggagtggatgatttattagttccaagtgttgaaggatatttctattcaaatattaattggccactaagctaactaagcattcagtggctacacatgacatagaatacagattttatggaagtaattcggaaaagtgaataaacaacaaataaaataacagcaataatagcaaaccatggagaggagggagaatctgattcccaggttatgatattcaaaatcttcaattttcaattagaaaattacaaagcatgcaaagaaacatcagtggcacataccaggagaaaaaaaaaagcaatcaacagtaactgtctttgagaaagtgagaaagtgaaaacgagttcattactagacaaagactttaaatcagctattgtaaatatattcaaaaagctgaaactaagtctaaagagttaagttatgagagcaatacctcaccaaatagtgaataccaataaagagatataaattataaaatgggaccaaatagaaattttggaattgaaaagtagaataactaaaagaaaaaattactagaggggcttaacagaagatttgaacagaccaaagaaagaatgagaagacttgaaacaggtaaattgagagtatccagtcagaggaacaagaaagaaaaagatgaagaaaaattaacagagcctaggagaccggaggacattaagcccatcaatacacccataaagagcgtctcagagaagagagagaaaggggtagaaccatgatttgaagaaataatggtgaaactttgcaaatttgataaaaaatatcaatctatacatacaaaaagctcaatgaactccaagtaagataaactagaatagatctgcactgagatacatcataatcaaactgttgaaaatcaaagacgaatagagaatctcaaaagcagtaagagagaagcaacttattatatagaagaaatcctcagtaaaattatcaactgatttctcatcacaaaccatggaggccaaaggcagtgtgatgacattcaaagtgctgaaaaaaaaaaaaatactgtaaaccaagaattttgtatcttgcaaaattatccttcaaaagtgaatgagaaattaagaaacctccaaataaataaaaattgagatagtttgtcactatgacacctgacctacataaaaaaaatctgaactcaataacctaaactccacctt

SEQ ID NO: 40131 - DNA, 425 bp, Homo sapiens
catgcttctccactgtctccttttcattttagcagctctgcttgatgcctttggaatgtgctttagtttctgtcaatttgattaagaggaggcaaagagaaagtaacaactagatgaaaaatgctttgtactctgtgtgacacagataggtatgggaatgttgttgagtagagtatagaggtgaacactgttgcagggaagatgtggtaagatgtggtggtgtttcaggctgaaccacagagtgcctgtgtggcgtcactgtgggtccagggtctagatctcaggtttaaataggagctggattttttaagttcatttagttattgtttcttgagaataggttcatgccaaccacttcaaagagtcatttataatctggagctgcagtgtctaatatcagagccacaagtcgcatgtagcaattt

SEQ ID NO: 40132 - DNA, 365 bp, Homo sapiens
actttctcaaaataaacctttccttcctttggggacttatatgcgagcctgatagttttaacagaaataaatgcattttagctcccttaggggatatcctccctcctctctctaccacctcaccccagatcctgaaagccatccaggggtgtccaagggagagaatacaatcatggattctcagtttctgtttctggttgggctagtaaagcaccttccttatctctcttttctgcttattagtagggacggaaactaaaaactatggcttccagctgctaaaagcccaaaacaaaacaaaacagaaaacaacaacaaaaggcagattgcacaagcttgcatgggtagcatggacagttgacata

SEQ ID NO: 40133 - DNA, 363 bp, Homo sapiens
catgctgtctcggctttaagctttgttcagaccctttccctcagtaagtcataccctgctgacttactgggccttacatgggcctgccacttgttgctgcaagagtgtttgtgcctcttccttgtataagtggggcgtggattgagcttcagggacgcagcatagagcctgtctcctcctgataacattcgtccacttgaaaggggagtctcaggctgggcgtggtggtgcacacctgtaatcctagctattggggaggctgaagcaggagaatcgcttgaacccgggaggcagaggttgtagtgagctgagatggtgccactgcactccagcctgggcaacagagcgagactccgtctccaa

SEQ ID NO: 40134 - DNA, 389 bp, Homo sapiens
gagaatgtgaccagcatattgccacagatgtaatgaataaacttctgcaatcctttgtatctttcactcaattttcaaaagtcctgagagaaagtctgtaatcggtcaggtttaaatcacatggctatcccttgactgcaccaaagagagggaaaactgaccccttcagtttccacagtgtcattggtgtaagtacattattaaactaacttatttgatgggcaaaataaataaccaacaaatctatttaaatatactaataggctgggcacggtggctcatgcctgtaatcccagcactttgggaggccgaagtgggcggatcacctgagctcaggagttcgagacaagcctggccaacatggtgaaaccctgtctctactaaaaata

SEQ ID NO: 40135 - DNA, 383 bp, Homo sapiens
aaacagacaaatagaaacaaaaacacaaaacagctccaaagagcccacgcttggttcctttggtgcctgcattcatgattcttggggccagggacctctgtgatattgcaaactcttcagcaagactgtggagcccctgaaacctcagagcagggagacaccaggctgtgctgtgcgcttgccataggaatgggctccccctcaaaggctgattcttcctgagtccaagccaagaacgtttgcttataaaaataccaaaagggggccaggcacggtggctcatgcctgtaatcccaacactttgggaggccaaggtggaaggatcgcttgagctcaggagtttgagaccagcctgagcaacatagtgatgccctgtctctata

SEQ ID NO: 40136 - DNA, 408 bp, Homo sapiens
ttttttttttgacagggtctcgctctgtcgcccaggctggagtgcagtggcatgatgttgggtcactgcaacctctgcctcctgggttcaagggattctcctgcctcagcctcctgagtagctgggattacaggtgcacaccaccatgcccagctaattttcatattttcagtagagacggggtttcaccacgttggctaggctggtcttgaactcctgacctcaggtcatcagcccgtatggtagggtttttaaagcattattgacatttaaagctggatcattttctggggtgaggccgtcctgggtactgcagggtgccgagcagcaaccctggcctccaccaactccaaaccagggggtcccccaaatcatgacaagcacaaatgtcaccaagaatccctgggg

SEQ ID NO: 40137 - DNA, 476 bp, Homo sapiens
tgaggtccagacctgcaccttgttgccttgtcatgtgactttacaaccctcggtgtcctcctggctgctgggccccagcctcctgactgttcagctcacacacgtgaacctaacacctgccttggtcccctgctccatcttctagacaactcatgctgaggaccagcccacaggaggaggcctccgagttctctcttgacgtcttcaccttgaccttttttgccaccattttagtctgtccaggcctttctgccctttctacattccctttgctttcagccagtgatgccaccccctactacactgagcaaatagaatctccctgatggcagcccttcttcctcatgtggccaagccaccaccactcctgccatccctcttcacaaccatcttttcttccttcccctgcctcatgacagcagaggaggtgccctctcctcctgtccaggcttgccccgtgctggccttgcccccat

SEQ ID NO: 40138 - DNA, 483 bp, Homo sapiens
tgaatattcatgtagcttgagaagaatatgtatgctgttgttgaaggaagattctaggaaaagtttcaatcaaaacccagtgattgatagtctttgattcagcaatatcattagtgattttctgcagaactgatctgtcaattattgatagaggtgagttgttttccctcaactataatcctagatttgtgtattttgccttgtggttttatatgtttttgcattatgtattttgatgctctgttttatgggcatagatgttaaggattattatgtcgtgtaggattgacttcttgatcattatgaaatctctctatcccttgtaatttttaaaaaatctaaaacctgatttgtctgaatgtaatataggtcttccaaatttcttttgatcagggctagaatggcatgtatttcttcatacttgtgtatttaatgtatctgtgtctttctgtttaaaatactttttaaaaatataaaaaaatt

SEQ ID NO: 40139 - DNA, 476 bp, Homo sapiens
tgctaatgaagaagttcctagaggtcagatatttcattttcccacagtggatgatgggatgctcttgtatgctgcgtcccattatttgtggtagttatgttctatagtcactgtgaacactgaattagcgaataccgagtcactgcttcttaggttcctgtgagtctctggacacaacattttcattacattatgattaatacataaccttatatggtgtgtgtttctgtttaatggacaccttatttaatatatggctgattcattacattgagttcacaaccaatagcacagtagctcctgcctgcaggacggttctccagtgggcacgccacagcctctggtgcttagcaacaacagacagcactttagcaagctctacgcttcgggccatttatttttatttttattttttttaatttttttattgtggggggggtctcacgatattgcctaggatggtcttgaactcctga

SEQ ID NO: 40140 - DNA, 368 bp, Homo sapiens
attatgctgagtgaaagaagccaagcaaaataaaatagtgttctcctactgagataaatttgtattctatttatataaaattttagaaaatgcaaactcatatttagtgacagaaagaccagtgattgcctgggagtgggagaaggaaaatatggcaataagtgaaagagagagattaaaagggtcatgagaaaacttttgaggtgctggatatacttattatcttgattgtggtgatggtttcaccatgtatacatgtcaaaacttgtcaaattgtacatgttaaatatatgcagtttattgtgtgtcagttataccacactaaaactattaaaaatatttctataacttgcaaaattaaaagatac

SEQ ID NO: 40141 - DNA, 2143 bp, Homo sapiens
tgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattcta

SEQ ID NO: 40142 - DNA, 213 bp, Homo sapiens
gcttgaggcaggatggctcctcatcgcccccctcccacagcacgcacaccctccggagatgggatgggccacccttgtccgtccccgcaggccagtcccctgctgtctgctgcttggatctgacccctgcataaatacgcaagcatgtgtccctgctgtggtccgggggtccctgtgggggggtccctgagactcttccgggagtcatgcaag

SEQ ID NO: 40143 - DNA, 695 bp, Homo sapiens
tttcagacaaaggtcttggatggatgctaaaacttttgggcaaaagacaactagggaagcctgctcttatttacacaagctcaaatggtcatccccttgatggttaattacaaagggaaaaatctggcccgcgcggtggctcacgcttgtattaccagcactttgggaggccgaggcgggcggatcacctgaggtcaggagttcgagaccagcctggccaacatggtgaaacctggtctctactaaaaatacaaaaattaaccgggcgtggtggcggacgcctctaatccaagctaccagggaggctgaggcagaaaaatcgctggaacccgggaggcggaggctgcagtgagacgagattgtgccactgcactccagcctgggcaacagagtgagaccccgtctcaaaaaaaaaaaaaaaaaaaaaaaaagagaaaaagctacctttataatggagaaatctggtagtcacactcctctagccaagcacaacaatgaacaccacttcaccatcacaactaatgagacgactgacattcggtaccccttggcatgatgcacagagaaggccacaactcacctatgtagtattcctgccaaaaatgtttaatccgtatcagttcataaggaaacaataaggaatatccaaattgaagggcattctgtgaaacaagtagcgtggattcttcggaaat

SEQ ID NO: 40144 - DNA, 322 bp, Homo sapiens
aagatcttcccgatctttatttcattggttccattcatctatttcttcaatttatttttgtttgtttcattgttgtaaatcatggtccatttttgtaggtccagcaaatctgtgtgtgtgtgttcacacgtgcatacacgtacatgtgctatgcctgaatttccttacttttataattttgtttattggagatgggtgctatttttgttcaagttcaaaatctgtctgcaaaacttaaataacatcatactttatctcttcacacacacacacacacacaaacatctaggatgttaactaatactgtatttatgataattgg

SEQ ID NO: 40145 - DNA, 395 bp, Homo sapiens
cctaggcagaggaccctgcggccttccgcagtgtttgtgtccctgggtacttgagagatggggtttcaccatgttgaccaggctggtctcaaactcctgacctcaagtgatttgctggacttggcctcccaaagtgctgggattacatgtgtgagccactgcgcctgaaccttcctgttactcttcaccatagtttcctgctcttttccatgatggtcctgcccatggtttctaatgattgattgatcttcttgtttaaagttgttgtcctctttactctgtaaactccctgtcaatagaaactacatgtcttatcacgataggtaaaaaacatgtactccgatgtcagatggcctggatttgaatcccggctctgttacttataagtcatggaa

SEQ ID NO: 40146 - DNA, 323 bp, Homo sapiens
ttgtccttacagtaattattttgatcttttaagttagtttctcctctgaaataaatatgctatacctacctcacagggtggttgtgaggattaagtagattgatggatgtggagcacttagattagtgcctgaaacattgaaagggctcaagaattgtagttctgttgtattacttaatgtcataatagtaaacaaatttactcatctttggttacttggccagtttattttggaaagtcttagagactagctttaggaaaatctgtctaaatgcatttcattttagacaagtagggagtttttatccattgataatagtcta

SEQ ID NO: 40147 - DNA, 1428 bp, Homo sapiens
atagataactggagcatgctctaaggaaatggcaacgttcctagctctcttcatcttcagtgtcaccaaagctaggtgctgttctacagtttaactcttgatgctaatggcttggaaagaaagagagtgaacacaacaggtttccagggggaggctcggagttcttactcagtattggtgggactgtacttgttttaggatgatgcatcatagcctaatctaatttactgagcatctactaagtgccaagcacagttgtagctctaacagggccagctttgctgtttctagttctgcttaggctactaacccaccatgtggtctcgacagactatgctgagctaaagtatcccatttctttttctgtgtaaaataagagggcttggataaatgttctctcaggttcttccagctcaaacacaatattatttattccttatatattctgaatatgtatactttaaaactttagctgctccacttgaaaatctaagtttttattgtcctcctcaaaggactccttgcttcattatctaatgtttttccctttgaagagagtatttcattcctaagaggggtttaaaagaagattcacctggtctgaacctgatattctccaaatgacaattctctaacctaaatttaaaaacacaagcaaaaaaggactgagaagctgagatgaggaagctctgttgggcaagtcaaaatggggccaataatatttacttcacagggttattaaaagagataacatatgtaaagcccatagttcagagcctgacgcttaacagacactcaacaagggatgttcttattctttttttcttgagaaacgagctaatcatttgaaatgtaaaattttgttcatggaattgcataagataccattctatttctacaactatttctgtagtcttaaatgccctgcattaaaagattgttgtttaatatattgtacctcttttgccatctatttgttaaatattggctgcctggtttctgattttgctgaatttgacttttttaaaaaaaacctaattgttttcttcaagaatacaagccaacattgtaaaggatgatttactctaagataatgctgaaatagatgtggtatgaaatgttgttaaatttataagataaatttgggatattcttttactggacaaactttttattaagaatatattgtttcttgaaacactaagttttgggataagttattaaaacaaatttgggagtggcttagttgggtgtttctcacttggatctctcatgagattgtaaacaagatgctagccagcgctacagtcacttgatagcttgtctacagggatttgcttccattggttcattcatgttcaggccagttgcccttcaattctcttccacgatcagactctgtccctggtgatatctactccgagtata

SEQ ID NO: 40148 - DNA, 331 bp, Homo sapiens
gagatattacagtatcagactcttgctgtgtaccaacaaagaacaagagataggtcagaacgctgtttaaataaattgcttgattgtactcttttaagcaggagtttatagtggtaacatcaaagtgcttaaaaaaattcaaaacaaaagcctttttcagtttcaaggaaaaccttaacaaggtgtgttaaaaagataaggtttttagaggttgggtgaggtggctcacacctttagtcccagcactttgggaggccaaggcaggtggatcacttgaggtcaggagttcaagaccagcctgaccaacatggtaaaaccctgtctctactta

SEQ ID NO: 40149 - DNA, 1492 bp, Homo sapiens
cccagaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggcgcgtggcctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagttccccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggcttccacgacggagcgtccacatcgtgcccggtctcactgcagacatgggcgcttctaaagtcgcggccgaggctgggttagcgggctgaagcccgcggggccgcgtcctaaggttggtttgggcgtttggcgggggtggccggtagtggtggcctccctggcccggggggggggcctcccggggggc

SEQ ID NO: 40150 - DNA, 1624 bp, Homo sapiens
gacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccag

SEQ ID NO: 40151 - DNA, 1533 bp, Homo sapiens
cccagaagtctttgggaggcggccccacgcctcaggcgactggttgttaccgaggaagatggcggcgccagacccgaggcgctagggaagatcgcaccgcggacgcccgctgagcttggcgcacgggccgaccaggacctggcttcctgccctcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccag

SEQ ID NO: 40152 - DNA, 2003 bp, Homo sapiens
gacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccagaaaaaaaaaaaaaaaaaacaaaaaaaaaacacaacaacaacaacaaaaaaaaacaaaaaaaaagggagagacaaaaaaaaacacccgaggggccaaaaatcgacaaaccaataaataaaaaagggcgcccacaaaaagagcgaccacacacaaaccacagaaacaacacagcacaaaaaagaccaagcaaacaaaccacaacgacggaaacccagggcgagaacacacaaacacagagggggggacacaacagcgcaacacaccacgacaaaaaagacaagaccacacggacaaaacaaaaaaacagaagagacaagcggacacaccaagcgcaaaagccgcgcaaaacaagacgcacacgcaagagaagagaacaaac

SEQ ID NO: 40153 - DNA, 1545 bp, Homo sapiens
gacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccag

SEQ ID NO: 40154 - DNA, 1284 bp, Homo sapiens
cccagaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgcccgtgcagttctacaaggtgtgcgtgagcgtggtgagcgagaagtgccgtatcgacacggagatcctgccctccctgttcatgcgctgcaccaccgacctcaaccgcaaggacaagttccccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggcttccacgacggagcgtccacatcgtgcccggtctcactgcagacatgggcgcttctaaagtcgcggccgaggctgggttagcgggctgaagcccgcggggccgcgtcctaaggttggtttgggcgtttggcgggggtggccggtagtggtggcctccctggcccggggggggggcctcccggggggc

SEQ ID NO: 40155 - DNA, 878 bp, Homo sapiens
gacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctctgggaaggacaggtccaataaacgccctctgcgcccag

SEQ ID NO: 40156 - DNA, 197 bp, Homo sapiens
tcttccgcacctgttttgccatgaggttgctgaggtgcagaggcgaagcagcttgcccagctgaccgagcgcctggtgtcagagtcgaactgctcttctcctcagctggagccttggcgggcgcctctgctccggccccttggggtgacctggcttcctgccctcaggtcctctccacccggatcctggccatgaag

SEQ ID NO: 40157 - DNA, 1004 bp, Homo sapiens
cccagaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggcgcgtggcctggccgacatcgccttcaccggcggcggcaacatcgtggtggccacggcggacggcagcagcgcgtcgcccgtgcagttctacaaggtgtgcgtgagcgtggtgagcgagaagtgccgtatcgacaggacacagcaggccggtggatgggatggggtggccatcgtcagggtggcttctgtccaggcatctgcctctcagtgtgttgtct

SEQ ID NO: 40158 - DNA, 1447 bp, Homo sapiens
aggcactctagccgatccttcataggttctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccag

SEQ ID NO: 40159 - DNA, 1681 bp, Homo sapiens
gacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctttcctagcacaggtccatgctctgtgtgggtgcttttgggatggcagccacttccaggtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccag

SEQ ID NO: 40160 - DNA, 758 bp, Homo sapiens
tttttgagacagggtcttgctctgttgcccaggctggagtgtagtggcgcgatctcggctcactgcagcctctccctcccgggctcaagcgattctactgcctcagcctccctcacgttctcccctctcccgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccag

SEQ ID NO: 40161 - DNA, 349 bp, Homo sapiens
agtagatgagttttatggatgttgatgtttcttaagtgctcaaaacagttggactttttcctctaattattccaatgcattattttatctttgatttgttaaattaagaaacatttcagtatgttatcaactcctaattagagaggtctctattaagggccttttttgaaagtcataacatccctgtttctaaggaaaagggttgtgagctttggtttctttatgcttaaggctgttgtgaatgcagctgtggaaggggaagacagatgtctttgaaactcttcatttctctaggacccaccccacttttgtattgtagtagggcccacccctcattcttaaaatcttt

SEQ ID NO: 40162 - DNA, 414 bp, Homo sapiens
tgtttgttgtgtggcctgccctgtgcattatagggtgtttagttagcagcagcatccttggtctctgcccactagatgccagtagtgcaccccatccccagctgtgacaacaaaaatgtctgcaggcattgccaagtgtgccctggaggcaaaatagccgccccctaattgagattgagaaccgctgctgcataggagctcctgtctgggacaaatgcccaccagagaaaccagcaagtaatagaaatgtggctttggaagggaacttagaaatcatctggaatgttgtatcctggagaactcctcgccccacaccagcgccagcacccctccccaaccccctacaccacctccacctttatacttatgctttatacctgcagaactataacctaagggaaggaatgaatataa

SEQ ID NO: 40163 - DNA, 626 bp, Homo sapiens
aaactccacactttgactaggaaaagaaatgatcacttctgaggtaactgtgatgtagatgtattattgtagacatggtaaactaccttattaatcttcacctcatggtggtattgactgggcggattgtaaaatgccattgtttgctctgtctttgataaacatgaaggatcaggtgtcatctctttagtgggtgagaaagtctctggaagaccattgaagctgcctaacaccaggtatcgctgaaaggatttttaaagctagtgagcaggttgccaggttgttcaaaggtagagtgggcagggaggtggctggctatccccagggcccagatgcagatgggcaggggtccttcctgccagcctggaaccttaggtgcaccctcagtctgtttcagggtcaggcagggcctaggtttaccagcagccatgaaaccattgagtcttttcttcatgacataccagtggccagtgtcgcagtcaacacagttccattggttctttttcctatctctttaaaatttaaatttataaaattatttaaatatttttatgggcttgtctttgaataattttaacagagattatccaaaatatgtctagtccttatttgtctttgaattttag

SEQ ID NO: 40164 - DNA, 490 bp, Homo sapiens
tatgtagtcctgttgcagactcagaatatggccattctgttatcttagagccttgtaaggatggatatcttcagagagtgaacctgtaagttacaaaacttcactctttcccaggaatggcaggtgggactctggttcccactccttcccttcacacccaagctatgttcactagcattactctgtttggatccccgctgaatgatttgagaatggctctacaacatctaatcaggaactctctgtaacacagatggctcatacagggtaatcctaccaccttcgcttacttctgtgactaaggcagacatcactaatcaatcaccacactttgctatcactttaagacaaagcctcaattactttttgttgtcatgcttcaagctgcacaaccaattaatcagagttgacacatgaaataaaacctatttgttatcctccccttttaggtataatttaaaaaacaacaacagctaaagaaaaaaagtaa

SEQ ID NO: 40165 - DNA, 789 bp, Homo sapiens
aaaatatattgtaagagataagcagggagaatactaacatctgccaggaaatttttaaaaacaaagttcaaactagccccattaaatatgtcatggtcaaaactgtttggtggtgaattatttttgccttccctgctgttgccaaagccattgatgatcacaggagacctcagcgaaaggaatcaggaagcagcactctcccccacctttttttccaaacgcacatgagtttcttcgtgaattccatttgctggatctcgtctgccagctgaagatcctgtactgatctgggtagggaccagcccccacacgcagccgtctgttcctgagcagaacttggaggtgtaactacattttcatgccaacaggacaaaatgatttcgctcagaatcaggttgtgttttcaagttacctttcctgtctaatcacgtggtgcttataagactgataaccttaaagcacactcctcagtgccggcaccatagaacctagttgagctttgggggcttttcttgagtacttataaaagattccacaccttccagaggggcaggttgtacgttgttgggacatcagcggctacttggtgtctaattcaagccttcaggtgttttactagttaacaagtgtaaatttcccaggttgtaaatggtttaagaggggaaaaaagaaaggcaaattatcaaattgtctgtttaaaacatagttttgcaactgctaagttctacttaaacataaacccaaatttcttttgtcctcttcaataataaattactttcttttatataa

SEQ ID NO: 40166 - DNA, 3428 bp, Homo sapiens
attaaccttctcttagtcttcaacctaagtacttgaatgtcaagtaccctccaaccctcaatgtcccaagacttttaagagcggaaggtaccgatgagttccatcctttactagggtcaccaaggaaggcatgggtatatggaaatttttattattattccatctgaatatcattttctagagaataggagcttttgttctgaagggctgccggcttccttctgggatctagcagccagggttagatcacaggtgtcactttcaggcgagtagttagcaacggtatcgctagcaactgagccgacccctgcagccagaggtttgcagtgggtagtgtgtattccagaaagggccctgacatgtgaaaggaaggaatgtgccctaatattctacagttgttttatcgttgctactgattaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagca

SEQ ID NO: 40167 - DNA, 3420 bp, Homo sapiens
agagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggtttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatatag

SEQ ID NO: 40168 - DNA, 779 bp, Homo sapiens
atacttcttacggcagtaccccataatgcttaacacagtactgaaatcagaacttctacttgggactgttcaacaccaagggcagccaaaccactgccaaatagcactttttcaaattacattctcagctgtccctctcacagtcaggtcaaagccctgcctatcttgcttgcctaagagcagtatgttattttaggcaactgtagatagtaaacaaaattgaagacttttgccaggggcatgtcacagacatttcaccagaagacaacttttgctatccattcctagagatcatagaatatgaaatgttaagtacaaaatagatttcatgggttaatatttgacctttttttgattttcttattaatcaaagaaaaatatgatagccagtcaagatagactgtcatttataataaatcgtgttgatataaataaaataaagtatcaaaaatatgactgtacttatgattcatatttaattttgcttaagattaaaatatatggccaggcatggtggctcacgcctgtaatcccagcattttgggaggccaaggtgggcagatcgcaaggtcaggagctcgaggccagcctgcccaacatggcaaaaccccatatctactaaaaatacaaaaaattagtcaggcatggtggcgggtgcctgtaatcccagctactcaggaggctgaggcaggagaatcacttgaggcggaggttgcagttagtcaagatcgcgccactgcgctccagcctgggtaacaaaagcgaaactccatctcaaa

SEQ ID NO: 40169 - DNA, 331 bp, Homo sapiens
caagaagataaagtgagactcaaggaatttcgaagtggaacaatacaccaaagccttaaacctgaaatgactctccttttctggggggtgagggggaaagaaaaagaaaaagtttctagggctctcggggtggcctggatgccagggtcccagaagtggccttttctagctcctgtaactaaacctggcggaaaactccccgcctgctcactccacccccacccgcccaagaatgcgtcttcccgtcttcggtggccctacccagaatcccaaaatgtgggttccaacccgggccctgaatgtcttctcaaatccccgggacccaggttcc

SEQ ID NO: 40170 - DNA, 433 bp, Homo sapiens
tcatcgacgcaccagaaggaagcataggcatccagaaatggtttgaaattaaaagttacatgaggccagtgagaacagagcactagtgaattttccacattttaaatggggtggtgtaccgaaaaaaataatggacaaagttagaaaactggctctgatttcctcttaaccacttgacgctctgtgatttgatgtttgccccgtaactactttgagtttctgctttttattagtaaagtatgggatttccaggtcatgttaggcattagatgagatttcatgtgtgcaaattgttttgcatacagtataatcaacaagtccttgtttaaaaaggcataagtcaattaatcaagaaagaatatgggaggccaaggcagtcagatcacctgaggtcaagaattcgagaccagcctgaccaacatggtgaaacccc

SEQ ID NO: 40171 - DNA, 531 bp, Homo sapiens
gaacacaaagcagaatctttctaaaatatttttgtttcctataataaatctttctcaaaaggatgttcttcctgtcactttttgaatgctatatttcatttttgtagtttggagactgtcttcacagaaatcattttgggtttttctgtgtactcaactttgaatgaagacaagttatttctggctacccaaagttaatattggatagatttaccaaacatttttgactgtttatcttggaggtattagaatagtacttttagatcttaagtaggagaaccagagatgcaggtttatgttagcagttgagtcactcagaatcctgaaaggcattgggggtgggatgggacaagatctgaaaaatttgcctctatagtttctctctgtgatcgttaaaaatattgtaataagggtgaccttttcctatcgggttttctatatggtagattactataagcttttcttctgtgcatacacatatattatgtatacatacattttatgaaaatgacattatagatgttattttga

SEQ ID NO: 40172 - DNA, 711 bp, Homo sapiens
ggagtgcagtggcacgattggctcactgcaacctctgcctcccaggttcaagcgattctcctgcctcagcctcctgagtacctgggactacaggcctgtgccaccacacctagctaatttttgtattcttaatagagatggggtttcaccatgttggccaggatggtcttcatgtcttgacctcgtgatccgcccacctcggcccccaaagtgttgggattataggcgtgagccactgtgcccagcctatttttctaatttttaaaaactctatcaaataacaacaatgttttgaattctcccatactgtcagtatggtatggggaaaataaaataggaatagaaaaggaaaaccaggaaaagaggtggttttcaaccaaatgaggattggacaaaaagaaaaaaagagaaagagaaagaaagaagcgtcacaaacaaatctggcattacttcgtatttaaaatcttatgaagagtaaggagaatgttgatgggtgtgaatgaaatagtgagaatcaatttaaagaatattcattaggcgccctacagtgtgcctgaaaatgtagtgtgcacagtgtataaaataagaaattgcttccttaaagtggcttatgtctggttataaaaataagatgaatgcaaaaccagctagcaatgctagctttatgtagcttcactctgagccagacatcatgtattagaaaacaaggat

SEQ ID NO: 40173 - DNA, 1589 bp, Homo sapiens
aaaaaagaaaaaaatatatataattttattttaaattggcttttatctttaattcttttttttaaagttatcaaatcttcattttctaagagtagccctttatagtgtacaaaatgatattaagtgcattattatcttcgcttttcatggctctgagtcataaaacaagctggtggatctcactgtacctaatttatagacgaggaaattgtcattcaaaaagattgactgttatgcccagggtcagcactaacctgcagaaccagtattcagtccccaagttcagtgtcttctactgccctctactaatgaaaagtgaaaatttccctggggtctaattctctcttcagtttgctgtgccgttgtttatctttgagtcttcattctctgaagatggctttctgcctgtttctggtacattagaattctcactatgatatagaaatggcttcagtttcatagcataatcttgcagttagctctgaattgcctcaaaaaccctgaacaacgcgaggttccagatgtgttttacttctttcattcatatttacccccatttgttgtttaaaaagaattatgaacaattattacatcatatgtagaccactttcactgattatatgttgacattttcctcagtaaaacataaagttcttaacaagactatactgtaacacctttctccaacaaaatcagctgtatgttgaaaactattaagtcattgctaatgttttaagccataatacagacagccttatactctatgatgggagaagggaaagtagtttgtccgatggtgctactctgtataaacattactgatgctatctatagtagggcaagaaaagtaaaaagagttttgattattcaggcagcatttttaaaaacctgtgaatttgtatcagttctcatctaaacatttggacacaagtataaaatgaaaacatatgcacaagttatggtttttaagttatctgctcttttttttggtttcactgtacctttgtactcttctattagtgggaataatcagacatgaactgtgacttcacatgtacagtcatacctcacttaatgatggagatgcactctgagaaatgtctaattaggttatttcatcgttgtgggaacatcatagagtgtacttacacaaacctagatagtgtagcctgctacacatgtaggacatgtatatagcctattgctcctaggctacagcatgttgctgttctgaatcatgtaggcaattgtaacacaatggcaagtgtctgtttattcaaacatctaaacacagaaaagatactacaacaataacaatatggtataaaagattttgtaaaaaatctggtcaggtgcagtggttcacgcctgtaatcctagcactttgggaggctgcctcagcaggtggattgcttgagcccagaagctcaagaccagcctgggcaacatggcgaaaccccgtctctgctaaaagtacaaaagctgaggttggaggatcacctgagcctggcaaggtcaaggctgcagtgagccatgatcataccactgcactccagcctgggtgacagagtgactccccatctaaaaaa

SEQ ID NO: 40174 - DNA, 356 bp, Homo sapiens
ggcctgggcattgttgggtcttgtgtgctctgtctctcatgggcagcacaagctgtccctcaggactccactcccttgcccattctcatcccccatcgcctcagcttccacacgtccgcgatgggccccccagcttctcttcaccacagctgccccaacacctgccccatcttctcctcctgtcccagttccatgttattatgggttggattgtgtccccaaaaaagctgcacctgtgaatgtgacctgtgaatgtgataaggtccttagggaagccctaatgcaatatgactgctgtcctcagaaaaaggggaaatttggatccagacatgtgcagagggtagacactgcgaaga

SEQ ID NO: 40175 - DNA, 467 bp, Homo sapiens
ctgtgtaaataaacacatcagaacataaggctctatgtgcaggggtgtttgttgcaacactgtcttatgtcacctcattacagaaaacactgaatgcatactatatcgataggggactggttggataaatactgctacatccatacaatggaatagcatatatgtattataagagtgagttaggactgggtgtgctgactcacacctgtaatcccagcactttgggaagcctaggcaacaggattgcttgaggccaggagttcaagagtaacctggggaacataataagactccatctacaaaaaagttttaaatatttaaaacttaggtgggcatcatgatgtgcacctgtaattctagctactcaagaggctgaagtggaaggattgcttgagcccaggagtttgaggctgcaaggagctatgatcacatcactgtactccagcctgggcaacagagtgaaacct

SEQ ID NO: 40176 - DNA, 356 bp, Homo sapiens
cccacaatctctaggagactcatttcagaaaacttcactttcaagattactaacagttgtctgctcatgattaggcttcaaaagaaaaatgttaaatttatttatatagaaaacagatttcatatccttattttacaaccgagttctctaacacttatgtgtctatcaaaaataaattaatgaaagcttgaaaacagttatgaattcattatactgctttcacatccacttcaaacttcctatatataaactgatataacatgggttcacttacccagctcagtctcactataaggatttttaaacaaaatcagtccagtccactgaacagtatcagcttactgcaggtacattgt

SEQ ID NO: 40177 - DNA, 880 bp, Homo sapiens
agtttaattgataagttaggcagagtaaggttaacaataaaacagaacaattgtaacaacacactgtaataaagttatgtgaatgtggtctctcaaagtgtctcactgtactgtattcatccccttttggaccacggttgactgcgggtaactgaaaccatggaaggtgaagccacggacacgggggactattggacaggcatgttaacagacacacacacagtgtgaagagcaagggggactatcggacaggcatgtcccatagtgtgaagaaacacagtgtgaagttacaaagtgaggcctcagaaccagattcggatatggcgaaagttttagagttatcagcttgggaactgaaataactgattaatatgagggtgcgaatggaaaggtggacagatgggaacagaagcgagagatatgcacactccaggagtggtacccagacatgccaaaatcaagaagaattcacaatgtacatcagaaagtattttgaacttcaagacaatgttaaaatatcaacacttttatcttgagatgttgccactacagcatttcggggagaaatctgttgctttacatgcttatattagggccgggcccgggggcacacacttgtaaccccagcactttaggaggctgaggcaggtggactggttgaggtcaggagttcaagacctgggcaacatggtaaaaccccatcttctcaaaaaaaaccccaaagttagccgagtatgttggcacatgcttgtagtcccagctactcagcagggggagctgaggtgggaggatcacttcaacccagaaggccgaggctgcagtgagccaagactgcaccactgcaatccagtataggcaacagagcaagaccgtttcaaag

SEQ ID NO: 40178 - DNA, 804 bp, Homo sapiens
acagccaaaaactgttatccaatgactattctgtgtaagataatcatttcacatgtttaattcttatgtttccttctgtgaagcatgtaggaagtttgggatatgatttcagtatttgatttagataaaaatttgtgcaggtctaagcttgaagatccacactactacagcacagacctctgcagcacagggccttggatagagtggagtaggcattcatgataagtttaactgaatagtattattttgtatactgatacttaaagaaaagaaatggcacctctcatttaatggtttctctagaagttttcacaatatacttattttccctttattccaatacatatttattaggctagaattcaaagctcaactgaaaactgctcaggcaattgaaataagtttttattgatagtgacctctgattggtgaggattcccagttctatgtttgtgtgttgagagagagccagagtatgtgtataagctgtagcaatcaaggtagaatggttttttggccagacgtggtggctcatgcctataatcccagcactttgggagacctaggcaagtggatcacttgagcccaggagttcaagaccagcctggccaacatggtgtaacactctctacaaaaaatacaaaaattagctgggcatggtggtgcatgcctgcagccccaactacttgggaggcttgggtgggaggatctcttgagcccaggaggttgtggctgcagtgagatgtgatcatgccaactgcactccagcctgtgcaacagagtgagactctgtctcaattaaaa

SEQ ID NO: 40179 - DNA, 198 bp, Homo sapiens
cttcctagcccattggagagactcagttttttctaaggaatgaatgacagcagaaactcatccatgatgagcaaggacctcctgaaacatttcagcatgtgtgcatgtgttgtgcttcagaatattttagaaacattttccagatttaattgaggcttctgggaagccttgctgtgttcttccttgcaaaaaatagaa

SEQ ID NO: 40180 - DNA, 395 bp, Homo sapiens
cgtttttgttctagggactatgatgaggatggggtctctgaggcctgagatatctctattgccatctgacaagggagggcctttgtttttgcggactcagttgtttcagtggccccaaattaaagagcgctgaaggagagagccagttgtaacagttggtgtcactggatctgataaccctgcttagctgggctagggccctgggtctgaaatattccagcaccgcctccgtggatgcagccgagcctctcaggtctcccgctagagctttgggaaatgcctcagagtctgtggcctccaaggcagccggcttctccgaaccccactggttgggtggggtgctgtattatcttcctagagaagccgtgaccaagtctcacactgggcggcttaaa

SEQ ID NO: 40181 - DNA, 317 bp, Homo sapiens
gctccccagatcaagccccctctattaaccccaccaccccgtgttttctcattacatttagactgaaattaaaatcctgcaagatcctataggaattagcccctgactccttctctgacctcagcatcttccactctctcccagtgtcccggtttcctctgtttcaaacactgtacggtagcaataatgtgtctcttgttcatcactgcacatctacaaaatatcttcacagcaacacctagattggtatttggttggatatccctcatgttttaactgtttaataaatatttctacaaatctacaaaagagtaaaa

SEQ ID NO: 40182 - DNA, 85 bp, Homo sapiens
gcaaacaaacaaatattttttaaaatttccaagttaggacaaatagaaatccacacttagaaatatattgtgaaataatagaaca

SEQ ID NO: 40183 - DNA, 559 bp, Homo sapiens
gatattaccttcctatcatttcaaaatattaaaagaatccagattcgacatccataatcagaagctcatcgtaacatttacaagtgtgaaagttgatctgttccattttgtaattaaaagggaacaaattagaaatttcaagtcttgtattcctgaaggaagaaaacattcaaaaatgatttttccctcttggaattattttaaaatatgcatattttctcttagttttgaaaagtggcttaaaatagacttattttacccttctgcagatgcaaagtttttctgtctttctagtgattcactaattggtttactactgaattatttattccatgagtcattacattttattgttaccaagaagtgtaaatttagttagagtcagatgcttctgtagttcatgaaatcacaggcgtttttccgtagcgctgtccacttttaaaagatgagcaatgtgagtaactacacagccaatcttagcacaggtgctaagaagggctaagtcactaaaccaccttgcctccagctctgaaaccaaaaaagcctagtaaaaaaataa

SEQ ID NO: 40184 - DNA, 646 bp, Homo sapiens
ttttttggagatgaagtttcactcttgttgcccaggcagttcttcattagtatttcttacaactgaggtttaatgagaattggaaagcaaagagttgaagttagccaatttgttaaggaccaaagtgaagataatctaaaagtcggcattttaacgtactgtatagcaaaggagaacactactttcccccgaattctttcacatttcttcattgttctgcaagttgcctgttgaaggacctctagggcaccttcttctgtgcttcagggtacttagtgtctgtgaattagactaggcataggcaagttgaagtccttgaggaatgactttattcttggatgtaaatatgggattgacattttttatcacaaacactatttgtactgttaatttactatcaaatcataagcattccatagctatgagaaacctaagagaacacagtacagagtggaaagagcgaagatttgaagccagaaagtctgggattgtgtcactgctgtatgtgcagggttgtttccagccggttgatgaacctccctgaatctatttccttatttgtaaaattagaatgatgagagcacataaattcatttatggaataaatgttgagaatctactgggtactgggtagtagaaaaaaaaa

SEQ ID NO: 40185 - DNA, 237 bp, Homo sapiens
cacaagttttattccctcagcacacacttcagatcacagaaaggagacaaataaggtggaggaaggaagatgggttgatgtaactaggtcacttggtaattcaatttcagacgtaaatttttctttgtttcagaattattgatctgtggaatatttcttgattcttcttggaaattacaaattaattcaaatgattgtaaagttctctgaaaggctctacagttttcttaagagaat

SEQ ID NO: 40186 - DNA, 496 bp, Homo sapiens
ggccctctttcctcttcctggtttccttacctgccctccccttactcttgtttctcctccgccgaggcactgtgcggtatttgtaaatattgggcgaggaaagtctcggaagaagaaataacgctgataataatactttattaatatttatagtaattattataatactaataacacaatccaagcgcatgacaaatcacataatttctaactgtcaatggaggatgcatcttcccattccaccccgcgctcccctcaattaggaggagaaaccgcacaagctaccaaatatataaaaggcattgattcccggagcaaaggggaggggagggggcccgggtaatgtacatagctgttcaagttaaggtttagtttccttccttcccctctggacccctaagctttcacttttcctttaggttccctttcctccccattcccaccctcagccgggctcaggcaatagtatattataaagaaaatgtctacattaagc

SEQ ID NO: 40187 - DNA, 266 bp, Homo sapiens
gtttcgattaacaaaggacatgatatacagtcacgtgccacaaaatgatgttttggtcaatgactgactgcacatagatagtggtcccactagattataacggagctggaaatttcctatgacttagtgacgtcatagcaatagtttcagtacagtgtattattcacatgtctgtggtgatgctggtgtaaattaccttgctgccagtggaataaaagtatagcacaaacaattacatacactacataatatttgataatgataat

SEQ ID NO: 40188 - DNA, 380 bp, Homo sapiens
cctgctttgaattattttggatatatacccagaaatagaattgctgcatcatatcatattaactttttaaaacctgagaaattctgcattccaaaattcatctagcgccaagtgctttggaaatgggattgtggagctgccttatgcttgttaggcaaatgaaactaagctttaaacatttttcctttcttttaaattttaatccttaaagttagtttatttccacaattgactgtctcacagaataaagctagccttaaaatttggccgggtgcggtggctcacgcctgtaatcccagcactttgggaggccaaggcgggcggatcacttgaggtcaggagtttgagaccagcctggccaacatgttgaaatcccgtct

SEQ ID NO: 40189 - DNA, 734 bp, Homo sapiens
cctgatttaaatatcccttctattatgttcccataggatcaaatccttaacacattataactgtttgtttatttatccgtccctcactgtagactgtaagctccataaaagcagggactatatctaactcaccattgtagctccagcacctagcacaatacctagaacacactcaataagcacttatttatttgtttatttttgtgctaggaatcttgtacagaatcaataagcatttatttaaaagaatgaatcaatgaatgatacagaagtcagaagaaaggaagccaactctcctaggaaaagaacaatttgccattaaatgaattgaaagtacatgagaacaaatgctaggcaggagagtccaccttttccaaaaaagaatggcagcctgatcagaattgcttaggaatttatgaacgataaattgaatgaaacttactataaattcggctgggtttttttgtttgttttgttttgtttttgagacagagtcttgctctgttacccaggctggagtgcagtggctcaatctcagctcactgcaacctctgccacccggattcaagcgattctcctgcctcagcctcccgagtagctaggactacaagcaccccccaccatgcctggctaatttttatatttttgccatgttggccaggctggtctcgaactcctgacctcaggtgatccaccatccttggcctcccaaagtgctgggattacaggcatga

SEQ ID NO: 40190 - DNA, 461 bp, Homo sapiens
accgcccactcgctcttcttgggtttactcctaattccacgcccacctcaccttgaacttcccactttgaaatctaaagatcaaaggtgtttcttggttctcacatagaaatcccccccttgaacttccttcctatctgtttcctcagcctatcttccctctggccgtgtattattcacaaagagttctacaggatgcaaagataaaatttaatgtactttccttagcaaccggaaaaaaaaaatccctgaaaaattaaacagcagatacccaaatagaaactttgctttagaaaaatgggatttgaccacacacacgtgcacaggccacacaaaccgtcataaccttgaccagcttaagagaacaattctcaagccagtgagaaaacaacagctgtggccgggcgcagtggctcacacctgtaatcccagcactttgggaggcccaggcgggtggatcgc

SEQ ID NO: 40191 - DNA, 650 bp, Homo sapiens
ctactcaattattccatttaggaatctaaaataatcaaactcgtagaagcagaagcagagacttgaatggtgattaccaaggtttgggggagggtgaatcagagagatgttgatccaagggtacatagtttcacttatgcaaggtgaataaatcctagagatctactgtacaacatcgtgcatatagttaacaacactgtattgtgtacttaactgaatcttcatgtgggcagtcgggtacctaatgaataaatgcagaagccatgaggtctcatgggttgcccgggtcctagatattgcactgtcactcctgccacctttgaccctttatcaaaacaagttttaaaaaacagcccaaattcaaggggatggagaaattgatgccacctttctgatgtgagaaatgactatgccatattgtaaagggacatggacacggagatcattaatataatgatttgcccttccaggttatgccttataggcatttttggtacctgtatcccttctattaaatcataagttccttgaaggcagaaattagatcttatttacctttgtatttccctttgcaacgatcacagatgttgcacgctatgcaataagtgttgaatttttccggatgacaagacaagtaaaaggtaagggca

SEQ ID NO: 40192 - DNA, 321 bp, Homo sapiens
gtgctgagtaccctgatgtcaaggacgtagtagatgacatagtatcccatctttgatcatttactttatcccacattataaactcaatgtctcagaaaaacagtgctaatactatcaccatcaattaaagtaggttaaaacattttgcatattttccccattctctccatttaaaaagtagtcttactacacataactgttgagcatataattattaccttttttttttgagacagggtctcactctgtcatccagtcacccaggctggagtgcagtgacacaatcatagctcactgcagcctcaatctcccaggctgaag

SEQ ID NO: 40193 - DNA, 619 bp, Homo sapiens
gcgtcgaccaagtagctgggactacaggtgcccgcgacctcgcccggctaattttttgtatttttagtagagacggggtttcaccatgttagccaggatggtctcgatctcctgacctcgtgatcctcccgcctcagcctttcgaagtgctgggattacaggcgtgaaccaccacgcccagccatatatcaggaacttgagcatccatggagtttggtgtccaagggaggtcctggaaccaatccgccatggatactgagggatgactataatatgaaccttgtatgtatgtaatttaccattttctagttagccacattaaaaaaggaaaaagaaacaggtgaaaaatatttaaaaaatacgttaacacaatatatccagaacatgatttcacattgaaatcaatataaaaattactgaaatagtttacagtctggtgtgcattttagacttaaagcatatccctttgggcatggtagcccatgcctgtagtcctagctgcttgggaggctgaggcaggagaatctcttgaacacaggagttttaggttatggtgagctatgatcgtgccactggactccagcctggatgacagagtgagacccgactccttaaaaaa

SEQ ID NO: 40194 - DNA, 414 bp, Homo sapiens
gtttgagaccagcctggccaaaatggtgaaaccctgtctctaccaaaaaatacaaaaattagccgggtgtggtagttggcacctgtactcccagctactagtcaagaagctgaggcaggagaatcgcttgaacctgggaggcagaggttgcagtgagccaagatgacgccactgcactccagcctgggtgacagagtgagactccgcctcaaaaaaaaaaaagtgtaatacctgtttttaataacaatgccattgagggcacaaagagacaagaactctcatgtactgctggtgcggtgcaaatcagcataactattatgggaactacttgacaatatgtaggataaagattgagtacttactatatatactatttaagtttgtaaaaagtgagcacattttacttttatagtc

SEQ ID NO: 40195 - DNA, 462 bp, Homo sapiens
gcttgacatatgcttgcaaagtgcctggtcataggtggtgctcagaacagttggttcctgtgaacacataaagacccttaagccaggtgggagtcaggagggagggaaggaacaggctatgggccagatttgaccctggagctgtaagtttgctgatccctggtctagcataataaatcactgataaatttgccttaaatataaagagtcaaagccttggccagttgtggtggttcatgcctgtaatcccaggagtctgaggccagcctaggcagcattttgagactccaactatacaaaaatattttaaaatttttaaaaaattggccgagtgtggtgatgcatgcctgtagtcctatctactcagaaggttgaacccaggaggtcgaactgtgctgctgtattccagcctgggtgacagaggaagaccctgtctctaaaaaataaaataaaatatctcgg

SEQ ID NO: 40196 - DNA, 805 bp, Homo sapiens
aaaaataggtaaaaagagcctccaaacctgctttgattttattcacctattcttttaggccaggaactaatttacctctcactatcctgttccctcttgctatcttgtggagtctctaaagacaaaggtataaagagcttttggtaggtgaattaataatcaactagatggcatttccaaatgggattgcacatactgtggggcaagtcccaagtgaacttcaaagtgagacgtttatttgagtaatccttccagattaacaataatcataatagcagttaccacttcctgagtactttctatatgccatgtattgagcttgctcacttctttatgtggattcttatttaatcttaataccaagatgaggtgtagagattaataccaccattttatagagtttgaaatttgggtttatgaaaagttgagcacagaacctaaaatgttacaaaggtagtaagtgacagagtcaagatacaagcctgtgcagtcaaatttcaggggtccttgccagaaacctgttactgtgattcctccctgtccctccctctcactccactccacatccagtgaaataccaactcctttatgttcaattttctgaatagctttcaaccccagacctcctcactgccagatcatttttctttttttgagacagagtcttgctctgtcacccaggctggagtgcagtagtacaattatggctcactgcagccttgatctcctgtgcccaagtgacactcccacctcagcctcacaaggagctgggaccacaggcatgctccaccatgcctagctaatt

SEQ ID NO: 40197 - DNA, 330 bp, Homo sapiens
gatgaaccttgaggatattatgccaaaagccaaatattgtaggactcatgtacataaggaaactagaatagtcaaattcatggaagcggaaagtagaacagtgctttccaggggttacgtgaggtttaataggatattaaagttattggttaatggataaagagtttcagtttgggatgatggaaaaaagttctggaaatggatagtgatgatggctgcacaacatgtgaatgttcttaatgtcagaatgtaagaattccagaatgacttagtacttgaaattatgtgagtgaatgatttgcaagtaaacattaaatcattatgtggctc

SEQ ID NO: 40198 - DNA, 325 bp, Homo sapiens
  misc_feature (324)..(325): n is a, c, g, or t
aaatttgagtttgagttttgactgcaactttttgtatgaccttgggcagtcactttttctgacccttcagtgtcttcatttggaatgtcatagcaagagtaatacatgtagtctagcactcagaatttaaccacactctgcaatgggtgtaaggagtcatacggggccgtatgacttaactctgttccctatggaggcttctcctggtcactgggcactgcttccatttctttgtctcccacagaagctgtttggcttctccatttttgtcaaagttttgccagcctgcactagagtggtattccttaaatttaaaaaaaatann

SEQ ID NO: 40199 - DNA, 390 bp, Homo sapiens
gcgggggcggcgggggagaaggggccgctggcacccaccgcatccttcacgcattgccaacatgaaggatgagggtcacttagtgagtagccaggatccaaaacaaagggcttcagatacggcctgcaggataaatttgtcaatgtcttgtgccttcaggcacccagcctcggctgaccctaacctccattcccaagataaataactctgtcacagttcaccttcattccctggacacaaattcaagttgtcatccatcattcctgcccagaaatatcataccctcttacaataataaatataacttcaagtatcatttcttagcagttctctgtacagtcgcgggggaaacgacagggaaggcttcctttctctccgttcacatccttt

SEQ ID NO: 40200 - DNA, 647 bp, Homo sapiens
tttttcccccctaacttcaaatagaatttcccacaagggcatttaaattctcaggaatataacctgaaaattatgtttctgagaccatgtcatgtttgggtgaataattttacatcctcttccaaaaagtccatgaaaactttcaatgtaatatttataaactgattatcctgtgcgcctcccccgacatggcaaacagtgttttgtgaatagcaccaacctttacctatgcttgtgacctaagacccagggatgctatcaaatgctgtttctcctttttgagattctaacttaacatggacataatcccattcctcttgagaagtaaatcacattcgagcagcttctttagcgcatctgcaaatggcctaagatggtaagcaccagaattaaagccaatgcttttggttaattgaaaattgaagttatataaaacgtgttggcttctaaattaaagcttgagcatttcccccagtatttcctggctgccttacaacgttctgaagcagtcattttgattcagaaacatttggcactatgttagacaaactattaaactgttggctaaaaaaaaaaagtaatttggagaattgctatcgacggtgcaccccgaggactccttctggggtggggctcagaggtgaggt

SEQ ID NO: 40201 - DNA, 368 bp, Homo sapiens
ccttgctgcactctgaagtaaacacaaaactatgtcagagagaataaaaatgccattgtagtagtaaatagaataacttaaagtattctacaaatacttgatttttcacataatgcaatttaacaaatttttctgatcacccaatatgtcaaccactatctgaatggacagatcttgaagttagcctaacacaatatcttgtgatttgtctcttaccagtggtaccacccataaataggctagaattttttgtgtctaatactgaattcgacaaccaggaaaatcgcttgaacccaaggcggaggttgcagtcagcagatattgcaccgctgcgctccagcctgggcgacagagcgagactctgcctc

SEQ ID NO: 40202 - DNA, 329 bp, Homo sapiens
tatatcacaatacgattattctcttagtgactcatggttaaaggaactcagggagggaaaagcctacataaccaatacagattttaacagtacatttgaaactttacaaattataaacttatacccttttattttactataataatgacattcattttatactgctttatgttttacgaggactttgatttatattacagtgtctcatttagtgttttttgtttttgttttgtagttgttgtttgtttttttgtgagactgggtctcacactgtcacccaggttggaatgcagtggcatgatcacagctcactgcctcctcaaattcct

SEQ ID NO: 40203 - DNA, 488 bp, Homo sapiens
ccagaacacaaggagtttagccaactggtgttttgaagcttcatctgacaataagttctgtgattctgtttataagtctgtgacgagtgacccgagtgactggagggagccccataatgtctagcatccatttctgagtcatgacaaaaagccaaaggggaaatggggcagggaaaggaagcagatacaggaccagtagtcatataaggggctgtgcacaccatgtgagcccctgcctaccttctacagctaaatgtcagtatttcattcattgcccagccacagttctcccttcctgcttctacttggtgtgaacatttgaaagctcattgcaaagtcttcgctcaagagaaacagctggtgaactctggttttgaaagaaaaaatggattctgaacggctaaagcatctggaattttaaaaattacatgattgttgcacagaagtcattcgctaaggaatttttaccacaaagtcattaaagttag

SEQ ID NO: 40204 - DNA, 683 bp, Homo sapiens
  misc_feature (23)..(23): n is a, c, g, or t
  misc_feature (26)..(27): n is a, c, g, or t
ccacagacgcccggggcctgtgnggnntcactgtctgggcagatgctcacagcagcacgtggtcccacagagttcaggaggctctggtaggggctgttttgtaaaggaaaaaaaaacacacacacacaaacattttttcaatgtagcaaaatcaaacttaaaaaaaaaaaagaagaaaagaagaagatgccgacagtgcggagtctagccttttgtaaacttcatattgcacactagggactataagccattgctagctcattttgaattttaacgtgtaatttttgttttattttctttctgtggggaaacaatgcttgatccaccaatgctctttttaatgttttataactatgtatgtgtatatatataaatatcaaataatatgtatgcacatatgtgtgtgtatatatctatatgtatatacatatatagatatatagagatatatagagaggttttgagacaaaaaaaatacagaacgtgaaacccgagctgaacagcgtgtgctctgattacttgaatctggtctcctcggcacctggttattaagaactgaatatttttccacttgaatttagtgctattagaaatttaatatatgtgttttatttatttgatttttttttttttttttgcatgactgatgcaaggtttgacattttcactcaataaaaactgga

SEQ ID NO: 40205 - DNA, 386 bp, Homo sapiens
  misc_feature (36)..(36): n is a, c, g, or t
gccaaaaaaaaaaaaaaaaaaaaaaaaaaaaaaaanaaaaaaaaaaaaaaagggcggccgctcgcgatctagataaatatcaaataatatgtatgcacatatgtgtgtgtatatatctatatgtatatacatatatagatatatagagatatatagagaggttttgagacaaaaaaaatacagaacgtgaaacccgagctgaacagcgtgtgctctgattacttgaatctggtctcctcggcacctggttattaagaactgaatatttttccacttgaatttagtgctattagaaatttaatatatgtgttttatttatttgatttttttttttttttttgcatgactgatgcaaggtttgacattttcactcaataaaaactgga

SEQ ID NO: 40206 - DNA, 2080 bp, Homo sapiens
ctaggagcaggggtcccgggcgaatgcggcgcagctcccggccgctgccccggcgcccctccccgcggccgattcggccccgcgaccattgctcaggactgggacgggcgctgggggccaccgggacccccaccgcgcgccaccagggcggggtggctcctggagccgctggcggggcctccctcatgcagctaggatcctcccccctgcccagggggagacgggcagaaggcagtcagcacgggtgacactacagggaccgtggaggaagcctcacgggagtagcagccgcggagctccagctcagccccaccccagggcccggctgctcccccaggcctgggtcgggtctgtttggcgactccctggccccagcctccgccccagggaaaccgaggctgcgtccaaaacccagagtagcccgctgggggccggggcggggtctcggccaccctggtggtgcaaacaggaaggatgcgcctggttttggctttaatgttcaaaatggaaaaaaatacaagaaagttgtacagtatttttcctgtaaaggttattattctacatagaacaaaaaggaagaaagcaggcgtggtgagagtgcagacccgcctgggcccggcctgaggttggaggctcagtcccgtttatcctgtgggatttggtccagggtttttgtagaggccttaactgtttgaggctgtctgtcttcacaatagcactgatgggagctgcgtgattccaactcttaacttgaattttgtagagacaagaaaaaaggactattactgttgatccaagtttgtagttaatttaacatttgagttctctcttggtgatgcgtgtggctttatagggctttttttttttccagtttgttttattactttgtttgggatgcttcttcgctggtgcagtctacccagattgggttccctttgcaaaacatcccccttcctggagatgatgatgccatcgaagcccgggccagggcctgacctggcaggcacacacctggccagtggctctgaggtccccggggaccgagtcccctgcgagggcaggctgcccgaggccacacctgcccaccttccctactccaggccaccagctggtgtcagattgggccaccgggagagaacaggcctaggagggaatggaaggctggcggggaggctgtcatccagaagcctcctccccagaggtctccaggaggaacctggctcaactggggggcagtggtttacttttcccttttttcttcctttcttttgtcctctcagctgcccacagccagaaagccaggaccacccgaactggacagggagcagggagggaggagtggtcgcacggagcgtacctgattcaacaggaaatcagttattttctaaaacagcccctaccagagcctcctgaactctgtgggcaccacgtgctgctgtgagcatctgcccagacagtgacccgccacaggccccgggcgtctgtggaaggagttttgtaaaggaaaaaaaaacacacacacacaaacattttttcaatgtagcaaaatcaaacttaaaaaaaaaaaagaagaaaagaagaagatgccgacagtgcggagtctagccttttgtaaacttcatattgcacactagggactataagccattgctagctcattttgaattttaacgtgtaatttttgttttattttctttctgtggggaaacaatgcttgatccaccaatgctctttttaatgttttataactatgtatgtgtatatatataaatatcaaataatatgtatgcacatatgtgtgtgtatatatctatatgtatatacatatatagatatatagagatatatagagaggttttgagacaaaaaaaatacagaacgtgaaacccgagctgaacagcgtgtgctctgattacttgaatctggtctcctcggcacctggttattaagaactgaatatttttccacttgaatttagtgctattagaaatttaatatatgtgttttatttatttgatttttttttttttttttgcatgactgatgcaaggtttgacattttcactcaataaaaactgga

SEQ ID NO: 40207 - DNA, 575 bp, Homo sapiens
ggattctctcaatgttgaatcccatttttttccctcagtgaatcttcaacatttttaaatcttagcattcaacaaaaactctacagcctagatataaaccatagattactttttatatagcatatacagttcatcaacaaacagtaaagtttccttcatgacttaccttgaaatctttattcaaaggatatactattcaatttttcagtgtgccactgccaccactgcatgtttttggtcagagtgcagtgcaactaacatcgccatcctgctaggaaaaagatctgcaggttgctggatagtggaagttgcacacatctaatttacaagtcagattagagatcagaatcttacaatagctttatgtggaattgatttcatttcatggtttttaagctgttttttcattgaagcaatgcctgtaactgaaagacaggtgtgttgtagcatttgaataccttaaactcttttgaatctggaatgaaagggatgttctggattctaaaactcagagattttgaattaaatgccatcattcatttattgtgccataattgaactaccttgagaactga

SEQ ID NO: 40208 - DNA, 399 bp, Homo sapiens
tacggaattcggaggcttcgggtacccggatctagtagcctataccccttggacgtcccctcctgtaggaaattaagtttccattaaaggtagagtgagcacctgtcacaacttgcccttccacagttatcaccgggtacctttcatgcatcgtcccctgggtggttagaatatgatctggccccaagccaaggcagttggttgttccacacagcaaggattacctgactttgcagtgcacagccctcctcccagccaggcttcttattctctttgtaattcctagcaagtcactgtcctttctaggcctcaattttctcattgtgggagggagaaaactgaattgggagatcactaaggtcctgcactgtgaaaattgtgcctctgtaagtactaaga

SEQ ID NO: 40209 - DNA, 605 bp, Homo sapiens
aagtggtactgcacagagtagctagctctccagctctagagagtgggcagagcctcactgcaaacgtcagtccacatctgctccaatagtgacctcagagaggcaggttttctgtcatcttgtgatgtgtaggttcatcagatcaacttgttcttggttgttgctcactcttgggcctggccttggccctggccctgcttatgttctcttgggtctttcctcagacccctggctgacagcctagccagcaccccttggacgtcccctcctgtaggaaattaagtttccattaaaggtagagtgagcacctgtcacaacttgcccttccacagttatcaccgggtacctttcatgcatcgtcccctgggtggttagaatatgatctggccccaagccaaggcagttggttgttccacacagcaaggattacctgactttgcagtgcacagccctcctcccagccaggcttcttattctctttgtaattcctagcaagtcactgtcctttctaggcctcaattttctcattgtgggagggagaaaactgaattgggagatcactaaggtcctgcactgtgaaaattgtgcctctgtaagtactaaga

SEQ ID NO: 40210 - DNA, 397 bp, Homo sapiens
tcatcgacggagaagaatgcaaaataaatattactctaggcgtgtagtactttaacaaaacagataatttttatctacctctgctcctgaatacagtctattggtgcagagtgtgtgcctttttagcctaaaacacaccaaacttagataagtgctctccgtgacttatgctaaggaagacaagagatatttgtgaacctaaaaggaattggacctatctcaagcctgttcttcagaccttaacgtatttttatttttttaaatctaaaagacaagaaagatatagaactataggggtaaacagaaagtcaagtgtgtaaagccaaatagtggcaggacttaagcagtcttccagagaacaaatcaaatttatcaattcacaactgcagagtcgatt

SEQ ID NO: 40211 - DNA, 326 bp, Homo sapiens
gtctgtaaagcggggaaaataccttataggattgttgtaaagaataaatgagttgatatatataaactagcacataggacagtgcctttatttatttatttaaacaggcttgatatataatgttatataaattgctgctgctggatttgattcctagaagttaaatatttgaatattaggcccctttggctaactggctattcttctcatcatttaatgtgaatagatatgtttttagatttattatctttagtttccattgccagattaattttctaaaatgcaggtgataagaaatgagtgagctgaaggacatgttctataga

SEQ ID NO: 40212 - DNA, 797 bp, Homo sapiens
tgagagctatgccacctcgagtgctcctggctaagcagtgttccttgggctaaactttgaacacaaagtaactgactgaactggtttgcccctgagttcacactcttttgggtacttccccatgaagagtataggcattttctgacttctcatagttcgcaaaggaataaataagaacaaactctaaattaccacagtgacagtgactcatgaccatagcaccagaaaagacccttggagccagagtactttggttgtgtgaattcccaggtgtgggcttagagagatagtgggatctttttttgtagtggtcttgctcaagtggaaaccctgcaatgtttcagcagctgttaaggggtgcaacaaatatttaaacccacacaagtggcaaaggctgctgagctgctatttatgtaaatattgtaatttgggcctgaaaggaattagattttgtatattaataaataaaattggagtaaagaaataaatcatctatctttaccacctttctttgcaggcctctagcttgatttctgtatctcttaaagacttatttaggatgaagatattggtcatacagccttgtaggcattgctatatcaagataattttttcctcatttagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgtaagtcaggtgcataaaacaaaacaaagca

SEQ ID NO: 40213 - DNA, 438 bp, Homo sapiens
tagctgggactacaggtgcacagcaccacatccagctaatttttgtattttcagtaaagaagggatttcaccatgttggccaggatggtcttcatctcttgacctcatgggtccatcccccatccggcctgcctatttttttagaaagattattttttaaagttcctatgtaatgacatgcatttttttatcttttaaaagttgtggccgggtgcagtggctcatgcctgtaatcccagcactctgggaggctgaggcaggcagatcacctgaggtcaggagttcgagaccagcctggccaacatggtgaacccctgattctatctattaaaaatacaaaaattagcaaggcgtggtggcgcatgcctgtaatcccagctacttgggaggctgaggcaggagaatggcttgaacccaggaggtggaggttgcagtgac

SEQ ID NO: 40214 - DNA, 208 bp, Homo sapiens
tgcagctaattagaggaaggctggaattcaaacctaagtcctgacaccaagtcccatgataccacatcttttgttactaattaagttgatcccttttattctttgtcctttgtatgtgtatgtgcgcatgcatgcatacacacacacacacacacacacacacacacagaactgatctctctttctggaccagtgcaataggcgtcag

SEQ ID NO: 40215 - DNA, 155 bp, Homo sapiens
gaagggccaggattcaaaaccaggactccaggttccaagtgtcaggcccgttcgaccacactgtcctcccaccagccaagagggcaattctggaatcagccaggagggctgtcaatcacaggacaaataaaatagtctgtttttacttagctgga

SEQ ID NO: 40216 - DNA, 786 bp, Homo sapiens
gggaagtgagagtttacagagtcattggaagggccgctgtattagtttgccagggctgctgtaataagatcaaggtcttgggggttaggacttcaacatatgaatttgggggtggcggagcacaagtcagctcataacagctggggaggaggctttaggcctggccctgagaaattactcccagactaaggctgcagaactgaccccctagagagtcaccaccttggtcatagacagcaagcagagagggaggaatcaggaagtccctgctgtagttgctggatccagcggtgaatgttctgagctgtgatcctgggatcaggaagctgcagccactgccacagtgttggttctagagccaggcagcatgagatccagtcatcgcatccacactacagctataagaaggaggaagggcagaaggttgtgctccaccctttaaggacacttgctagaagtcagacagaacgtctggtcacactctgtttgacagaagttagtcacatgcaacatctagctgcatgggaggctgggaaatgtggtctttgttcccaacagctatgcatatacagggccaaaaatctccagggagtatgatgaagggaaaatgggggaatggagtttgggggtcaagagtggtctctgctgcacctccctgaacagaggactctagggagactagtaattgaatttcaagataaagcagccagtgtggcccaaggttctccttcagtgcctgagctcttggccataggagctcacgcctcctctcctttcctgtgaatg

SEQ ID NO: 40217 - DNA, 237 bp, Homo sapiens
ccccaaaggcctttggaaaagaaattgtgttcatgtacagaaaaccaaaacaatattacactcttctgaatgtctctatttccttccctgacgtttacaatataagtattaaatagatttttaagaaggtaagttgtggtaaggaaggctctctcagcctgaaaatgcagtcactctctcaggacatggttgatcccaagacacctgcaacattgtaaagggtggaggatttttaaa

SEQ ID NO: 40218 - DNA, 420 bp, Homo sapiens
atcataaaattctaaaaactgtgacttcttgacacctgtagtaaatagaaattagactaaaaaaacaggtaaatagaagaactagtaagaaattagatgcaaaaagaatttagttttctactgttttttgatgtttgagagaactaggaatgctcattttcatgaatgaatgctgaactcatcatacacactctgagataagatataaagttatcaacttataactgtcttcgctatttcaatagaaaagaattgaaatacgtgagaaagacataaactattcagaaaacaacattgcaaattgaagtaacaaaaaattacagtacaatgtgaactacatttcttttttattcttttttaaattgatacataatatatgacatatttgttgggtacctgtggcattttgttacatgcata

SEQ ID NO: 40219 - DNA, 380 bp, Homo sapiens
gtcaatacaggatacaaactgggcctcactgtctgctctgccatgagttttcctaagccacacctctcctctctaactagggtgaacaaacatcacctgctctactggcataattattaatagtgccctctttctctctcaaacacatctcggattgatctgacctgagtggttaaaaaataaatattatagaataagatgcatgctgtaattccaagtaataatgagaaaaagctcacctatgtgtgcaaggttcctctatgcagggagcatatttggaaggacactgctaaccacggttacctgaggatggtttggggacacggacagcactgcattatttttacacgcattgcattctaaaccaggcacttgtttct

SEQ ID NO: 40220 - DNA, 88 bp, Homo sapiens
cttttgtgcctaacaaggtacatttctccctgctgggtggagattttagtatggtaatgaagcaagaaatgagttcagtgcacctatg

SEQ ID NO: 40221 - DNA, 348 bp, Homo sapiens
taaagaaaactgatagcaacattgagtcctttgatccttgaacacagtatacctctccattcatttaggcctttcatttttctcagtagtgctttgaagtcttttagtatacctttaatggtggtcttcatcttgttcattcagcaagtatttattgagcattctgttctgtgccagctactattctgtctgctggggaacaaagccctgccttcagggagcttatgttctaactgaggaaaccagatgagaaactagtgagttaaatatatgctagatggatatttgtattgtagagaaaaccaaatcaaggtgtaggggattagagtctattagcatgtgaggata

SEQ ID NO: 40222 - DNA, 544 bp, Homo sapiens
catcaggatagacaaacatagaagaaaaataatatttgatttgagccttaatggataaataaataaataaataacggggagaaagatgattcctagagtagggagtatctcatgcaaatgactgagaagcttgattaagttaatgtttaagaatgtggcaggccaggtatagtggctcatacctgtaatccaagcactttgggaggccgactcaggtggatcacctgtggtcaggagttcaagactagcctggccaaaatggcgaaaccctatctctactaaaaaatacaaaaattagccaggcatggtggctggtgcctgtagttccagctactcaggaggttgaggtaggagaattgcttaggctcaggtggttgaagctgcagttagctgtgttcatgtcactgcactcctgcctgggtgacacagcaagaccaccatctcaaaaacaaaaacaaaaaacaatgtggcatattaaaaattaaaatcacaataaaatcagagggtacattgtgagaagttaatagcaggagataaggttgaa

SEQ ID NO: 40223 - DNA, 390 bp, Homo sapiens
aagggggtgtaggtgaggaggaagatggtgatccacaactcggatgaccatatgttctgattgccccaaataaccagtatttttttaccaggtgtgccagtgaattgttaatagctctgacttagctttcaaaagtgtcctgttttgatgataaactatatggtcaccatatgtgtaaccagaagtactatgatcttctgcaatgtatcttaaagttatctaaccaagataacacttggggttctgttaaaggtaaatatccctgtgttcctcccatggatcttaattcagtaagtcagaggtggaaactggtattttgtatttttaacagttatctatgatgattcttatgaatttttggcattcactgttctacttgttaaaaaaaaa

SEQ ID NO: 40224 - DNA, 358 bp, Homo sapiens
aggcaccggcaaaggcaaatgctccgaagtgggacagagctctgtgcgtttgaggaagaggcagggccagtgtggctggagtccggaaaggagagagaggggacaggctaaagtcagggttagaggacgcagggccaggccactgtgagaagtgtgggctgtgttctgcggacttcctgaggactgggcggcgcggtgtgtgaagcccaggggtccagccaaggacactccttccttccgttgggactgggccagcagggctcaacaggacacccctgccagagcaggagggcctcctcggtgggccctgtggcttcctcaatcctgcagacgttcctgggagaaaaccagcttgtgg

SEQ ID NO: 40225 - DNA, 254 bp, Homo sapiens
cagctacttgggtggctgaggcaggaggattgcttgagccggtgggtcaaagctgcagtgagctgtgggtgtactctgggtgtactctgggtgacagagcgagaccctctctcaaaagaaaagatacattggttggctgggcacagtggcttacgcctttaatcccagtgctttggcctcccaggaggatcgattgaggctaggaattcaaaaccagcctgtgcaacatagcaagacctgttctcttccaaaaa

SEQ ID NO: 40226 - DNA, 560 bp, Homo sapiens
ggcttacacctttaatcccagcactttgtgaggccgaggcggatggatcacttgagttcaggagtttgagagctgcctagacaacatagcgagaccccatctctacaaaaaatacaaaaaatatccaggcgtggtgacgccttggcactagagcaagaccctgtctaaaaaataaataagtacataaataaaaataaaattcatcaaccgcgtgttgaattctcaagattccccttaaacctgagaactggagagagccatttcagttatatagtaaaattaaatttgtttatcatggattattataatggacgtatattgataaaatgtctaggtgagaattttacagttgtaattggaggtccatttaaaggttaaaatgaaatagagagttatggatgcacagctttccatattgtgtttggcaaaggaaattgattctcggaatgatatgctaccctttttgtccactatgtgtagtgcatatggatgatggaatcactttcatgagtacagttcttatttagaacacacattccgtaatatccctagaaaataaa

SEQ ID NO: 40227 - DNA, 1308 bp, Homo sapiens
ataagcaaagagcttgggccagcatctaggttttggtaaagatcaggacaatgtatacaaaggactaaagagtttgatggcaagacatagctattttggcatcttcctgggggaagctgcacacactggcctcatgtctggaccagcagtgagagatcctcatgagtattatccactaataatcaccaatcccagaaccacaggtagggcttgattcctctatgggactcccatgagcatagagtagagacgcccttggttgcattagacctctagcaatcgaaggccagttccagcctggaccaaggcctgcctctggttctgcacaatggcaagtcctattaggaggactaggagctttgtccttgaagtaaagacctgcatggtaactggtttcagttaggttggctcactgggatttgaagctgggatgaatggattccacactgacctttatcccatgggcctgttggactggctcttggggaactcataactgtaccatgtgtttgagcttcagtgagctcaaatgcagagtcaagtgggaagagatgcaagattgctaagtaggtggtcagctatctgccaggggtcttctcctaatggtagaccagctagcctgtcaatctgaagtctgcttttgtaaagctttgtgctgggggctatgatggatagtaataaaatgacattgtcctctcagagcttacgatctgccaaattaggaagcgtgttcaaagaaacccctagagagcctgagatgagttaagggtgaggttctaaccaaaccaggtgtagctttagcggtacaacctctgtaaatcactcaacttgtctgtaagtcagtttgctcatgtgtgaaatgatctcaaaaattccctctgcctctggctttataatctaggtggaaagatgaagcataaacacagtccatttgtagtttcccgggcctctgataacatctccaatctgagttacttaagctttagagccacctgttagcagcattcaaagcaagattgttgaggttggtgacaggtgcactgcacagttgtgccctgtgggtgctctgtggccatgaggtgagccagaaagacaaactgcacatgagtaggccaaccgctctgcagaacgtgcagaaaggttcattgttcatggtcagaaaataacattttgtattgtggtaaaaagagaaataacattctgtctcctattgtcacaatttataatgtaagattttaaagatgtaataaaaagttatgcacatcaataatgaaggaagacagctaaagcaagcaatatttgtgcaac

SEQ ID NO: 40228 - DNA, 1179 bp, Homo sapiens
gtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgcca

SEQ ID NO: 40229 - DNA, 1125 bp, Homo sapiens
gtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggtggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgcca

SEQ ID NO: 40230 - DNA, 531 bp, Homo sapiens
taaatctattcaatagaatattatgcacccattaaaatgtttatataggctgggctcacacctgtaatcccagaactttgggaagctgaagcgggaggattgcttgaggccagaagtttaataccagcctgggcaacatagcaaaaccctgtctctacaaaatttttttttttaattagccaggcgtggcagtgtgcacctgcagtccttgctacttgggaggctgaggcagaaggatggcttgaaccaaggagttcagttgcaccactgcactcctgggttattttggagaccctgtctctaaaataaataaaaaagaagttagagaccagcctgggcaacatggtaagaccctgtctctacaaaaaataaaaagattagctgggcatgatggcacacgcctgtagtcccagctacttgggtggctgatgtgggaggactgcttgagcctggaaggtcgaggctgcagtgagctctgattgtgatcacaccaccatattccagactggaagacagagcaaaaccttatca

SEQ ID NO: 40231 - DNA, 327 bp, Homo sapiens
tttaaatttttaaaattttgtagagacgagatctcactatattgcccaggctggtctcaaactcttggactcgagtgatccacccacctcagcctccccaagtgctaggattgctagtgtgagccaccctgcccagccaactatagttttctaaaccaacaaattctacttattttccagcctaagcaaatgcttacttgggctgttgtgatttccatcaatatctggttgttcttcttggaaagtaagaatagaagataaaatatagttttaaaaaatatgtaagtccaaggaaatgaatcgtatgttttatgccaacacagacag

SEQ ID NO: 40232 - DNA, 427 bp, Homo sapiens
gtgatgactagagtagaataattttagaaaaattaatttatgatagagctggctttgggaaaaaatcatattcactcaaatatgacttttaattaattcatcttaatagtctgacatttgaaatgcatgggacaagatgaagtggctgaaaggatgctgcaaataagccaggaaaaccgcaaaatgatgtttgagagttcctgtttcctacctctgaccgattataatacttttctcttatcagtggaatgctatctccattgtgggttattttgtatggccctgaacctatactttttctattgtgtatttttgatgccatgacaacagataatgtacttaatgtggaaacttaagaaaaataattttccaaggggcttttccaacctggttcttctgatttcttcaagtaatggtgaaggaccat

SEQ ID NO: 40233 - DNA, 599 bp, Homo sapiens
agtttcttaagcacaaggacaatgtcttatcccttttcttattattttaggtagcattatagcactgttattaattttgcacttaatgcattgctattaagtgaattcatgaaacttctatctgaacacagggctttttatagctattacaaatggcacagttaaatacgtaagtgcaataaggtaagctagatttgagatggaattaaaaaaatactttcccatactttacacacagaatgtagtttgtatacagtttaggaaaacctactaagaagggaaaatcacaatgttttattaggggtgaaacacaaatcagaaaggcttagggaaataaaaccaagaactagttttgttggtctatttgttatgataaaggctaaactaatgttaacaagagacaaatatagtggctcaagtaagaaagaagtttatttatcatataacaacaggtcacacattcaggctgctgggtctttcacgggctccttcctttatgttgctctgccacctcttagggtcttgtcttaatctgcacggtcaagctaggacattgtcacacttatcttccagtcagtggggaaggggaaagagagagt

SEQ ID NO: 40234 - DNA, 257 bp, Homo sapiens
acactggaggaagttgctgctgttgattcaggtactatagcaggatttgggtgtggacatccttggctgagagatgcaaaaacttttccccaagatctactgggaagaaatttgattcataaaagtttcataaggaggccgggtgtggtggctcatggctgtaatcccagcactttggaaggcagaggcgggtggattacctgagtttaggagttcgagaccagcctggccaacatggtgaaaccctgtctctgcaa

SEQ ID NO: 40235 - DNA, 1236 bp, Homo sapiens
tttttatagaggggtgtcccttacatttagaaaatgaaataattttgtatttgtgaaaagttacattccatccattttctggaaaaaaaaatgggtattgttctttaaaatgttcatgagctgggaggatgattattctggtttccaggggaaactctcaagcagtacatatgtgatactcagttttgtagactgcagaccataaccagcaattgccagttgcaaaaatgtgaaaaagaaataacttattttaaccactttgtacagcatattatttcccactagaaaaaaatctgcaaataatgaatttacaattataaataatcagacatgacatcataaatcaatcttcctccctactagcaagaggaaattccaatggctttttttccatcctaacacaaattacttttattgtaaacaaatgcttgcaacaaaatgcttttgttgtaaaatgattgatgttggggtaaagtctacttagcttccccacaaggtctttctggctagtctgcaggtagtagatgatggttccatctcggcattgtctatcctctccatattcagactgtgtgactgagcttccttgatttatatagcatctgacccaaaatcacaaaaaagtcactcctgatgacatttgcatggggagtctttcatttggacttcagttcttaattgccgaaataagtactagtgaattatgtagcgtttttacccaaaactaatcttctgtacaaagttgtgtgcatattgagatgattagttaaggcagtgtagttttttaaattttttctgtataaatttctttccttcttccccacctcaggcacctaccctactcctttcaaagcactttatatccctcttgaaatacaaagaaattgaaaaaaaaaaaaaagtaactgtctttaaaggaatttgtcttctattaggagacacagacttttattttgctttattctattctctttgtacttggagagcgtaatcaacttgtctcataatgggctagtgatgaaacaagggtgatagttggaaacagtcattacaacatggttatttttgttatatagaagactatcatgtaaataagtgcaatcgtgttcttacgtactggctaaaaaaaaaatattgcaactataaggatttttaaatgagggttgtgaattccaggaaatttcactgcaaaatttcttttggttttgttttttaataaaatggaaccagatgctt

SEQ ID NO: 40236 - DNA, 621 bp, Homo sapiens
atgaaattaataataataattcaataaattgaattatgccatatgtatcttttggggattggcttctttcactcagtataatttccttgatgttcatctaagttgttgcatttatcaatagtttttttctttttattgctgagtagggttccatggtactgatgtttaaccattcagtcactgaaagaaatgtgcagtttccggatttagttattacaaataaagtactataaatatttgtacaagtgttcctgcatgaaaatcagttttaatttctctgggatatatgcccaggagcacaattgctgaattgtatggtgatatggtttgactcagatctcatcttgaatttccacatgttgtgggagggacccggtgggaggtgactgatttgtgggggcatgtctttcctgcgctgttctcgtgatggtgaataagtctcacgagatctgatggttttaaaaaggggtgtctccctgcacaaactcattctctgtttgcctaccgccatccgcttaagatgtgacctgctcctccttgccttccgccgcgattgtgaggcctcctcagctatgtggaactgtaaatcgaattaaacctctttcttttgtaaaatgccca

SEQ ID NO: 40237 - DNA, 254 bp, Homo sapiens
ggttctgcgggggctgaaggcaggggctgctggagggggaatgggaggccagcagggtgccctgggcccttcaataaccacctcccaacccttgggacgggggtggttctgtatgaagtcacatttgaacagagtattccaaccacagtcgaatccagacacctcatttcacagatggggaaagtgtagctgggctgggtgtgggggctaagggtgctcttcttggtcacagccgagccccaggcttgtgggga

SEQ ID NO: 40238 - DNA, 339 bp, Homo sapiens
ttcaatcaaatcaagttgacacttagtattaacaatcagagtagttatgttctaggatttgaatggagtcacaaaaagacatcattttcgatattcaaagactacaattttcagcacctatggcgttttagtagagaaaagaatctaaatgtacaatttgccaagtcaaatattattcaattttactttatctttttgctatatcagtctcatttaatagagtcatgagcagcctgaaacagaactgtttatcttactacaagcttttcaaatataaaatttcacagaggcaagctctttataaaattttagtattggagataactgccctctatgaat

SEQ ID NO: 40239 - DNA, 420 bp, Homo sapiens
gtctttgcttttggtagcaaaataatactgatttcataaatgaattaggaagtattcccttattttctggcagagactacacagaaatagtgtaaattcttctttaagcctttgctagaattctccaatgaaatcattcgggcctattttcattttaaaattataaagttctattaagttgtagcactattcaaattatctatgccatactgagtgacttgcagtatgttgtactttctggaaaacttagtttattttcatcaaagttgtccaaatttatttctgtagatttttaaaaatagtatccttttcatgtccacaggctccagagtgggtgggagcatcccaaatctgataatctggaaatccgaaatggctccaaaatctgaaactttaagagtaccaacaagacactcaaag

SEQ ID NO: 40240 - DNA, 370 bp, Homo sapiens
caaagcatgttaattgtgttgcctcctttcctttcagtgataaagctatgtgacattttagatacatggacaacagaaagacggaattggacaaagaatgaaaatgcagggaagaaataaatcagcaaacaaaacactgaacgtgaaattggaaagtggttgtaatgggaaggatgaagatgtcccaaaggaagtaacactggcaacaactttcacattaaagaaacttttggggaaattttacaaatttaaatacaaaggataaaacactggaagcgatccatacttagaaaggaatatgacaattcactaaagcaaagcaagatgcttacttcatatcataaattacatgatttatgtgctaagaagc

SEQ ID NO: 40241 - DNA, 2562 bp, Homo sapiens
cgcctaggagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaaaacattttaccggattatggaatgtttaccagaacatgttttgattcttgaatgtacataataatgccatctaacttatttacgttcttgtttacatgtgggagcttttgttttcaaaaattattttgttaaaaaatctcaataaagatttattattgttgttcttttctta

SEQ ID NO: 40242 - DNA, 1977 bp, Homo sapiens
cgcctaggagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttacc

SEQ ID NO: 40243 - DNA, 680 bp, Homo sapiens
tgcatattcttcctctactagcttaatggatacaatttgtgaaataatatttaaaaatcttaaacatgtagctgtgactatcacatttttttgtctattagaattaattttttaaaaaagagtagacttgtttgctataagataatttgtgttgaaatgaacattattccagatttaatggctcaaatatgtatttatcaatttacttcactgacattttgaaggatttttttagtttgttcactgagtttgccttctgtaatatacaaaatagttgggctagactgtaaatatgtaagtctaacctgaagtttgtttgaaagtaactgctttgctccttctcccatatcccctagtcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaa

SEQ ID NO: 40244 - DNA, 361 bp, Homo sapiens
gatgctgagacgactctcttaatttccaccgctacagtcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaa

SEQ ID NO: 40245 - DNA, 2539 bp, Homo sapiens
gcggccgctccaacatcagaatctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaaaacattttaccggattatggaatgtttaccagaacatgttttgattcttgaatgtacataataatgccatctaacttatttacgttcttgtttacatgtgggagcttttgttttcaaaaattattttgttaaaaaatctcaataaagatttattattgttgttcttttctta

SEQ ID NO: 40246 - DNA, 2628 bp, Homo sapiens
acaggatcatcagtacttgtatgagagatatcagttatattagcaacattagtactagtgctagcattagtagtatttgttcgaacgggagtacttatattattaatagtagtactagtgctaacatcagtagtacctgttagagaagaagtagtggcaataagtacagtagtactaatggtggcatcagcagtacttgtcagagaaggagtcactgaaatgggaacggtagcaatagtactcacagtagtactacttgtaggagaaggcatagtggtattaggaacagtattactagtgttagcatcagcagtatttgtaggggaaggtgtggttgtaatagatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaaaacattttaccggattatggaatgtttaccagaacatgttttgattcttgaatgtacataataatgccatctaacttatttacgttcttgtttacatgtgggagcttttgttttcaaaaattattttgttaaaaaatctcaataaagatttattattgttgttcttttctta

SEQ ID NO: 40247 - DNA, 1287 bp, Homo sapiens
cgcctaggagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaatgaagaccatgagtgaacagttgtttcctaacccatggctatttagaatcttttgccaaagaatgacaatgatgcaaaaatgggaacagtttggattttaattagaactgtttaggagtgatgatgtgtaaaaagttgacttctcttttgcatggcacagagaaattatattccttacttcatgtcagtttatgttctaaatctttttcactgaatataaaaatcttgttaaatgccattaggcaccaacttaaagagggttgtaaaaatattaaaagtatatcgttaattctgta

SEQ ID NO: 40248 - DNA, 1200 bp, Homo sapiens
atataaactatacagtttatattccgtaaaccattttataatgttcaaagattaggtttgttattgatagtattaaatacaaaacctaatcttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgtatagtttatattccgtaaaccattttataatgttcaaagattaggttttgttattgatagtattaaatacacagtttctcttaacagtgatgggtgaaaacattttaccggattatggaatgtttaccagaacatgttttgattcttgaatgtacataataatgccatctaacttatttacgttcttgtttacatgtgggagcttttgttttcaaaaattattttgttaaaaaatctcaataaagatttattattgttgttcttttctta

SEQ ID NO: 40249 - DNA, 991 bp, Homo sapiens
cgcctaggagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaa

SEQ ID NO: 40250 - DNA, 983 bp, Homo sapiens
  misc_feature (968)..(969): n is a, c, g, or t
cgcctaggagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataacacttacccggggatttcattacaaaccagatgtgnnttccccccctctta

SEQ ID NO: 40251 - DNA, 876 bp, Homo sapiens
gcggccgctccaacatcagaatctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctaccacagcaaaaacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaa

SEQ ID NO: 40252 - DNA, 839 bp, Homo sapiens
cgcctaggagtgacttctccaaaaagtgtgttagttcccggtcacctgagctccgggtgacgcggctgcggtagctgcggatacaagccttccgcgggtcctgcctggcgaccccgacctcctcctgctgtctctccgctccgccaccccgaacccgccaaggtcctgtccttttcctcctgtcctttgccagcgttgggccggaccgggccgagccgggccgcccgggcgcagtctttaaccatggcgtccctcttcaagaagaaaaccgtggatgatgtaataaaggaacagaatcgagagttacgaggtacacagagggctataatcagagatcgagcagctttagagaaacaagaaaaacagctggaattagaaattaagaaaatggccaagattggtaataaggaagacaatgcaggcagttaacaagaagatggatccacaaaagacattacaaacaatgcagaatttccagaaggaaaacatgaaaatggaaatgactgaagaaatgatcaatgatacacttgatgacatctttgacggttctgatgacgaagaagaaagccaggatattgtgaatcaagttcttgatgaaattggaattgaaatttctggaaagatggccaaagctccatcagctgctcgaagcttaccatctgcctctacttcaaaggctacaatctcagatgaagagattgaacggcaactcaaggctttaggagtagattagtcaaaagaagtcatactattttgcttacttataattatgtagtataaaccaagcacagtgcagatttcttttacaaaacacatgtattttgcaaaaaaaaaaaaaa

SEQ ID NO: 40253 - DNA, 5115 bp, Homo sapiens
aacaagatgagctgatagggttcccaggctgcctggagttacataacccattgtgcttccaggacagctcacaatcttaggatttgccctaacaagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40254 - DNA, 2284 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcaggtgagaggtcccaagcacgtgtgactgtctcaggcagcagaagttacccgagccggcctcaggcttccccagaggagatgcaggagccgccagcggccacggaggaggaggaggaggaggaggaggaggaggaggaggggtctggtgagggcaccacgataagtcctgtaaacttggcacctttcccggaggcagagttttgggccattctcacctctgttccaggcaccatccgtagtggttctctgtctgtagcttccgctcgtctgtgtgggtgatgattaaagcattctcattgcacagttctgttttta

SEQ ID NO: 40255 - DNA, 861 bp, Homo sapiens
  misc_feature (194)..(194): n is a, c, g, or t
  misc_feature (406)..(406): n is a, c, g, or t
  misc_feature (434)..(434): n is a, c, g, or t
cattcctctgtgccggtccccgagatcgaccaggtgacatgtgcaccctcatcctcacgcagcttgacccctctgcgcttcctcctcataggtgatggtcctctttctcacctgctgccctcggatcggaagtaccacattcgccctcttcaagttctttcagctgtctttggaaggagaacccaccatggagngtaattctggactggaggagcacgactcattcctctttcaacgggggttgagcaacggactcgggctcactctcctccgcagcgctggggtagaactgaacagctcatccttcagtggacagctcatgccggagctgagacacctcctccctgatgtggtccacctgctcctccagcagctcgttcctctcggttagggtcttgttcttctncaacacgactggccgatgcgagcggccnattctaaatcccgctctttctcctcaagaagccgagtgacagcatctatgtcattatatgtcttagtcatctggccaactctttcagcacataaaaggaagtattttaacgtctcttcaatttgctcggttgtgaggtcaatgttggcatctggagaaatgagaggtgtatggagccagtcgtcgtggtcataaccgtagatggtgtcggctcttaacttataatggggcagctgctcctccagcaggctaatgatctcgacttccggaagatcggtgctgttgcacacatcagtaatggtgcaggcatcccggtaccctctgtagctgggagcatcttccacagcctcgcttatgtagtgttcctcagggatgcccaggctgcaggctaggactgcatggttgcatgcctccgaaggggcacgccc

SEQ ID NO: 40256 - DNA, 524 bp, Homo sapiens
aggcgtactagaggatcccggtcatctgctacacattctgcctgggaacactcagtagggagacactttggagacaggaggtgatgaacctttttatgtgcagctggtatgatagaaggaaattgggaaaacttgtatgctaggcacttttgtccagagcctgctgtcccatggagaaaaagttttaagcactgaaaaaatttgattaatgtatttaaatgtattatttgaagcatcattcacttgttgatttttacaatcccatgtcttaaaaaggatgaatccatgttattgtattgtaaataatttagatgattaaaatggattgtttaaaaagttttagattatagttttactttatttcagtgatatgttttatgttttaattattacgtttgtgggacaaggtctcgcttgttgcctaggctcgagtacggtagtgcgattatggctcgctgtagcctccacctcccagctgaagtgatcgtcctgcctcagtctctcgggctgggaccacaggcatg

SEQ ID NO: 40257 - DNA, 1030 bp, Homo sapiens
  misc_feature (194)..(194): n is a, c, g, or t
  misc_feature (406)..(406): n is a, c, g, or t
  misc_feature (434)..(434): n is a, c, g, or t
cattcctctgtgccggtccccgagatcgaccaggtgacatgtgcaccctcatcctcacgcagcttgacccctctgcgcttcctcctcataggtgatggtcctctttctcacctgctgccctcggatcggaagtaccacattcgccctcttcaagttctttcagctgtctttggaaggagaacccaccatggagngtaattctggactggaggagcacgactcattcctctttcaacgggggttgagcaacggactcgggctcactctcctccgcagcgctggggtagaactgaacagctcatccttcagtggacagctcatgccggagctgagacacctcctccctgatgtggtccacctgctcctccagcagctcgttcctctcggttagggtcttgttcttctncaacacgactggccgatgcgagcggccnattctaaatcccgctctttctcctcaagaagccgagtgacagcatctatgtcattatatgtcttagtcatctggccaactctttcagcacataaaaggaagtattttaacgtctcttcaatttgctcggttgtgaggtcaatgttggcatctggagaaatgagaggtgtatggagccagtcgtcgtggtcataaccgtagatggtgtcggctcttaacttataatggggcagctgctcctccagcaggctaatgatctcgacttccggaagatcggtgctgttgcacacatctagtcataagggaactgaagggtaggaagattagctggtggcccccaaatcaattgtgtcaatttgtgcatgcctttggagtttatgtctgcacatggcattggtttttcaattcgggcagcccgtcagggctcagcctctgccaggactctgccacggcaagctcattcggacaaacgcctgtgatggaatgcagaaaggggccctgttatgctaatttctagagagagcatttgatctttgcaaaaccacagaaacattcacctctgccttttaaatatgctataaatgatttgggggccac

SEQ ID NO: 40258 - DNA, 421 bp, Homo sapiens
atttttacaatcccatgtcttaaaaatcaacaagtgaatgatgcttcaaataatacatttaaatacatcattcacttgttgatttttacaatcccatgtcttaaaaaggatgaatccatgttattgtattgtaaataatttagatgattaaaatggattgtttaaaaagaaaaaaaaaaaaaaaaaaaaaaaaaaaaaaaaaaaaaaaaaaaaaaagaagaaaaaagaaaaaaaagaagaaaaaaaaaaaaaaatggggggcgtgcaaagaactagtgatttcacgagggtgggaagcgaagatactagtagctagtgcgggccgaggctcgcgtgccagcggtggcgcgcccgactggcgactggcgtcgggcgtagctggcggtcgggtgtgtgtgtacgacgggtcggcggcgtagat

SEQ ID NO: 40259 - DNA, 4906 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40260 - DNA, 4609 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcaggtgagaggtcccaagcacgtgtgactgtctcaggcagcagaagttacccgagccggcctcaggcttccccagaggagatgcaggagccgccagcggccacggaggaggaggaggaggaggaggaggaggaggaggaggggtctggtgagggcaccacgataagtcctgtaaacttggcacctttcccggaggcagagttttgggccattctcacctctgttccaggcaccatccgtagtggttctctgtctgtagcttccgctcgtctgtgtgggtgatgattaaagcattctcattgcacagttctgtttttaaatacagagtctgatgcctcctatttgtaacaatgggtgtagctcccctgcccatcttggaggtgcatggcccatcagggatctttaaagtgggagcaggaaagctgctaaaaaaaaaaaaaaaaaaagtgggcttttgggtccctgaaaacatcagtgcccttcttcctggtctgggtgtctccctgagtctaaggggaagattctcaagtcccctggtgatttccaagtggagctgagcagttttagggaaattgagtgctgggtcattcagaaggtaaatgagatcatctgttacctgtacgctgtattaaaatagaaccaggaaaggctcaggatttcagacatttcgtcagccttttcactttcccagcttcaatggaggtatatatgtcattttcttttcagcttacacatgtgttcaaagtggatttttaaaaagtgttttagcaatactccttaaccaaataaaccttcggagaacgtcactaagcttttccagagagaagaccctagatgaagttggaaaagagctctggctgactccacccactgtccccaagcattaaaggttgtggccatgagtttacagaattacccacattccagttgccactgggatgaaaagctttgtgctcagagctctgggaatcatgggatcacatggttactgtttaccccaacagcatgctctgtctagactggacctcccagccccttgtgttgggaaggcaaagcttttgtggagtcaggggggagactgagaaaaaatgaattaaccctgtgttgtcatcctcatgacattcctgaggattcaccaggttagaagtgaggacgtttatctttgtgattcataattttcatttgtgaaggccacaacactccccttgaaatacagggcaggaaagagctgaggttcttggtggtgtctcccattcccctggctaatttcagacagctgtggtcaagggattttacttgggatcaacttttccttttttccttgacattaattttagagaagtcatcaagtcatgtgatttgtttagcacataggtttatttatggtttgattttttttaggcagttatattactagattaagcttgtgagggaatgaaaatgttttttatttgttatctacacactcgaaaaagagaaaccagctgcggtactgtcccatttttgtcatcagcaccagtgtccgtcaggaaggcaggtggtggtgcagaaacatgatgcctggctgattttcgtggctaaaggggtaggccttatgttgattgggatgctcccctacagccttacaggtagaatagaaggtgagttctggaagtgcaaagaagcaccattaagtgcatcttctagaagttgtacagaaggactaaagcttatcaagtcaacaaagaacttaccttggaggatagagagagagaagggaccaattatgaggactgacatcctggccactctccttaaaataaacactgacatttttcttgcttgttctctctgtactcaaacctgtggcaaattcatcctagcaacgttatttgacgaggggcatgaacatttatagttgaaactgtagaaagggtcaggttggaggtgtgtaataaaaaagaattacctaggttgccaaaggtaatttaggaagggtctgatcatttagatgagagttctttggggcttattttctgggtaaggctcatctttaaaaactggcttcagaggggagaggggagaacaatgaattggctctattttctctattgggaattacaggaccattttgattcttagaatgtaaaaagcatatcgctaagtaaatcatcctggaggtcccaagtagctctatgcctgcaatcatggagacacaggcagacagataagcttcatggggaaggcatggggcatcctctgtcttgggatttgtatccatggtggtctggtccctgccttttaatccgtcctctacgcttgggcttttctgttaccaaacagcactatcccaggaactattgtctgcctgggaacactcagtagggagacactttggagacaggaggtgatgaacctttttatgtgcagctggtatgatagaaggaaattgggaaaacttgtatgctaggcacttttgtccagagcctgctgtcccatggagaaaaagttttaagcactgaaaaaatttgattaatgtatttaaatgtattatttgaagcatcattcacttgttgatttttacaatcccatgtcttaaaaaggatgaatccatgttattgtattgtaaataatttagatgattaaaatggattgtttaaaaag

SEQ ID NO: 40261 - DNA, 4662 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40262 - DNA, 3915 bp, Homo sapiens
taatcagctcggtacctttccaaagcggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40263 - DNA, 3180 bp, Homo sapiens
agaaacctagtctggattgggtcggaagctggaatttggtgctctgcagaccagtgctcaaaattgtggttatttttgaggactcgccttcaatccagaacatttgcgtttcaccttcctcgcccagatccagttaacaaggtagctcatcacttcttgcatctgttgagtgacatgctggattttaatttttattgtggttgtacttggatgcaaggaatatgttttgttcctcccaatttagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40264 - DNA, 3483 bp, Homo sapiens
  misc_feature (14)..(14): n is a, c, g, or t
cactgacctggagncgagtttcatgagctgaatcgcgtaccacactcagcatggttctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggaagggaggtgcagcagcatcctggcagtcagtggtgacatgcggagagcccacgggtccaggcgtcctggtgcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40265 - DNA, 3387 bp, Homo sapiens
actctagagactccccacctagggcgagctgataactcaggagcgagctgctaactcaggcgcgagctgctaactcagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40266 - DNA, 5022 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacactggtattctgatttgtattttgtttttatcttttcatcaaggagacgatctctttatgtaagacttgaaagtgtttagctctttgcaaaattaaatgaaaggcatatacttca

SEQ ID NO: 40267 - DNA, 1215 bp, Homo sapiens
ctcggtaccgaaatgtgcactcttctatatctacacactcgaaaaagagaaaccagctgcggtactgtcccatttttgtcatcagcaccagtgtccgtcaggaaggcaggtggtggtgcagaaacatgatgcctggctgattttcgtggctaaaggggtaggccttatgttgattgggatgctcccctacagccttacaggtagaatagaaggtgagttctggaagtgcaaagaagcaccattaagtgcatcttctagaagttgtacagaaggactaaagcttatcaagtcaacaaagaacttaccttggaggatagagagagagaagggaccaattatgaggactgacatcctggccactctccttaaaataaacactgacatttttcttgcttgttctctctgtactcaaacctgtggcaaattcatcctagcaacgttatttgacgaggggcatgaacatttatagttgaaactgtagaaagggtcaggttggaggtgtgtaataaaaaagaattacctaggttgccaaaggtaatttaggaagggtctgatcatttagatgagagttctttggggcttattttctgggtaaggctcatctttaaaaactggcttcagaggggagaggggagaacaatgaattggctctattttctctattgggaattacaggaccattttgattcttagaatgtaaaaagcatatcgctaagtaaatcatcctggaggtcccaagtagctctatgcctgcaatcatggagacacaggcagacagataagcttcatggggaaggcatggggcatcctctgtcttgggatttgtatccatggtggtctggtccctgccttttaatccgtcctctacgcttgggcttttctgttaccaaacagcactatcccaggaactattgtctgcctgggaacactcagtagggagacactttggagacaggaggtgatgaacctttttatgtgcagctggtatgatagaaggaaattgggaaaacttgtatgctaggcacttttgtccagagcctgctgtcccatggagaaaaagttttaagcactgaaaaaatttgattaatgtatttaaatgtattatttgaagcatcattcacttgttgatttttacaatcccatgtcttaaaaaggatgaatccatgttattgtattgtaaataatttagatgattaaaatggattgtttaaaaag

SEQ ID NO: 40268 - DNA, 2160 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcaggtgagaggtcccaagcacgtgtgactgtctcaggcagcagaagttacccgagccggcctcaggcttccccagaggagatgcaggagccgccagcggccacggaggaggaggaggaggagcataaagcacgaggtccctcagcaccttttggctcattcccactggggcgctgaacagctgttgcagagct

SEQ ID NO: 40269 - DNA, 307 bp, Homo sapiens
agaacttgctctcttcctgcacccagggctttaggaatcagcccgttgcttctctgtagcaagcatgaggagcctctgatgatcccagtcttgggtgactcactgtctctctgttgtgtctcaaggaagggaggtgcagcagcatcctggcagtcagtggtgacatgcggagagcccacgggtccaggcgtcctggtggtattttggaagggccaaatctctggctttagcactttggaaacttgttgatcttccttggtcttctacggctattcattgcttctggggaatggtgacttgtgaattt

SEQ ID NO: 40270 - DNA, 445 bp, Homo sapiens
cacgcatggacagatggtgaattatgaattcctttgttatttctagatgcttatgttttcctcatttgacactgagcaccattgactccttcaggaaacacaggtcttttgaatctctgttctccctctttccttttgtagaaagagcgggatttagaattggccgctcgcatcggccagtcgttgttgaagaagaacaagaccctaaccgagaggaacgagctgctggaggagcaggtggaacacatcagggaggaggtaagacattggaggccgaggcttccagaggggcccgccacaggcctgggagctggaggcatggctgaaggagatgagagaatggagtcctagttggaaggacgctcccgagggcacgaccgcggcctgagcccagaactgtctcttctgaaacgttcacctggggactaaaagccaccttccgcag

SEQ ID NO: 40271 - DNA, 2967 bp, Homo sapiens
acattaagactatatgaagaagatgacacagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaacca

SEQ ID NO: 40272 - DNA, 4257 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccgtgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttcca

SEQ ID NO: 40273 - DNA, 2977 bp, Homo sapiens
gccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcgctgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttctgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctgagctgcagcccaccgatggcactggtgacagtggggcatctg

SEQ ID NO: 40274 - DNA, 435 bp, Homo sapiens
gcattttcgtctaatcctccaaagttcttgcaccttcaagaccctcgtacagacattcattattcttcctcaatagaagaagggcggtttgttctcgagaagtgcgagctatgcgtgacatgcaaacaggaggtcgagggtcagcatgcatagcccagtctatcatctccgtgaagtggagcgcaatgaaataccagaattagctgcttcatgtcttaaaatgagggaagagaaaagcccaagcaaaggcaaggggcatcaatcgcagtgcgcctggtaacaaggttttggagggaaatctgtgtacctctcctgcgcgcactagcgcctttcaagatactctaaaaagaaaaaagtcccctttcccccaaaccggggaccaaccacctcgcccccagcggcccaccctccagcttcttcgccccaacaaagact

SEQ ID NO: 40275 - DNA, 1023 bp, Homo sapiens
  misc_feature (459)..(459): n is a, c, g, or t
gttttaccataatgatgacacaggtgcttaaccagctccgtgagctattggggtggctccttgccttgatttagtcttgtgcccacacactgacccatgcagacttagccatgcatccagcacaaattacgctattttacatgtttggtttaatgtattcgtacctgctagacattgtagccaaaagattgtttgctgcctaatcctagccagctcttagggtgactgcctaagcctgtattgctggcttcacaagtttttttgtttcaggtaaataaaaatcaaagagcgttcgaggcagccgcattgactcaccttgcagacaagcaagcagagccgcagagcagtgacccgtgcccagcgcctcgcagctagagctggattggaatccagggctttgcaggcttcctgcttcactcaatcctctttctgttgcctctggcctcaaggtgttggccntgggaggaagtagcagattaaattccatgggcacgaagtccgtagctgacgaatacttaatatgttgcagtttcacagtgaaagttggcaagtccagggtgggaacatgcctcaagcagctgagtcttctggattttacttctgttctttgcctctcaatttttgattttgttatataaaaagcaaatcagtaactattgcattatattctgcagtgactcaacagcgacacttaattcagccaacccaaggtttactgaactgctcgtggtgcccgggaaccgtgctgggataggatacagggacccaacccagtcctgatcattagcttagccagagaggtaaactgactgacaatcaatctgcccagggatcaattactatggaagctcatagtgtgggcccctaacccagactgtgggtctgaggaggtctcctggaggtagtgctatcctaacagagacctgaagggtacttggaatccagccacagaatactatttaccatctcattttactctcatgagaattctccccactgtaggcaggatgggtgttgatttaa

SEQ ID NO: 40276 - DNA, 1276 bp, Homo sapiens
  misc_feature (712)..(712): n is a, c, g, or t
agaccaaggcaggattagagtttgggactttcagatcccaccccccgacctccggggaggagagagggattgaaggttaagttgatcttcaatggccaatgatttaatcaatcatgcctgtgtaatgaagccttcataaaaacctaaaaaaggacggggtttggagagcttcctgtaagcgaacccgtgaatggttccaggatggatggcgcaccctggaaagggcgtggaagctccgagccccttcccacagactttcccccatccatctcttcatctggtgttcatctgatagcctttgtaatgtccttaagtagtaaatccggaaaacagtggaggaagaagagaatcaccacatatcgtatttagaggtcctgcagaaagggcagagcgagtttcatgtttgagtgcagcggatgcatgggcaaagcattacacagccgctccatggaagtgacaatgagccttgtctttcacacgtaactccaggaaccaggggaaacaaaaccaattccacccagaggtaaataaaaatcaaagagcgttcgaggcagccgcattgactcaccttgcagacaagcaagcagagccgcagagcagtgacccgtgcccagcgcctcgcagctagagctggattggaatccagggctttgcaggcttcctgcttcactcaatcctctttctgttgcctctggcctcaaggtgttggccntgggaggaagtagcagattaaattccatgggcacgaagtccgtagctgacgaatacttaatatgttgcagtttcacagtgaaagttggcaagtccagggtgggaacatgcctcaagcagctgagtcttctggattttacttctgttctttgcctctcaatttttgattttgttatataaaaagcaaatcagtaactattgcattatattctgcagtgactcaacagcgacacttaattcagccaacccaaggtttactgaactgctcgtggtgcccgggaaccgtgctgggataggatacagggacccaacccagtcctgatcattagcttagccagagaggtaaactgactgacaatcaatctgcccagggatcaattactatggaagctcatagtgtgggcccctaacccagactgtgggtctgaggaggtctcctggaggtagtgctatcctaacagagacctgaagggtacttggaatccagccacagaatactatttaccatctcattttactctcatgagaattctccccactgtaggcaggatgggtgttgatttaa

SEQ ID NO: 40277 - DNA, 1152 bp, Homo sapiens
agaccaaggcaggattagagtttgggactttcagatcccaccccccgacctccggggaggagagagggattgaaggttaagttgatcttcaatggccaatgatttaatcaatcatgcctgtgtaatgaagccttcataaaaacctaaaaaaggacggggtttggagagcttcctgtaagcgaacccgtgaatggttccaggatggatggcgcaccctggaaagggcgtggaagctccgagccccttcccacagactttcccccatccatctcttcatctggtgttcatctgatagcctttgtaatgtccttaagtagtaaatccggaaaacagtggaggaagaagagaatcaccacatatcgtatttagaggtcctgcagaaagggcagagcgagtttcatgtttgagtgcagcggatgcatgggcaaagcattacacagccgctccatggaagtgacaatgagccttgtctttcacacgtaactccaggaaccaggggaaacaaaaccaattccacccagaggtacagacaaagaagagcaccctcccaaaggagcccgcatgataagtggccacggcgaacatcactgtgatcagtcagaaaggcaggcgagttattagcttagccctgaacctcctacttaatgtagaaccagtggtgatggttaacagaccctggctgcagtgacaagcctgggacctgctcgaggaaatccaattgaaaagcagccaagaggaacaacaagctagaaacagatgttccagctaccaggatgtgcacgcatttaacctgaacatgtagttggggtgggatggtagcattcgtttctaaatatagtgatttcacttcttcccccatatagatattgtcaagtttaattatagccatccacattagttttgtcaaattttcagcaatttctttaaaataagaagatgtcagaatgataactgctattaagggaattcagggtgtttggtttatctacccagtcttactaaaacatttcagttaaatcatccactcttaaactccagtctcatagcaattaaaaattatcttttaaaaaattgcccaaatgaaattccaacagttcatgtaattatttgatttaatattaccatgttagtaaaatatctttaagatagtta

SEQ ID NO: 40278 - DNA, 1358 bp, Homo sapiens
  misc_feature (794)..(794): n is a, c, g, or t
agaccaaggcaggattagagtttgggactttcagatcccaccccccgacctccggggaggagagagggattgaaggttaagttgatcttcaatggccaatgatttaatcaatcatgcctgtgtaatgaagccttcataaaaacctaaaaaaggacggggtttggagagcttcctgtaagcgaacccgtgaatggttccaggatggatggcgcaccctggaaagggcgtggaagctccgagccccttcccacagactttcccccatccatctcttcatctggtgttcatctgatagcctttgtaatgtccttaagtagtaaatccggaaaacagtggaggaagaagagaatcaccacatatcgtatttagaggtcctgcagaaagggcagagcgagtttcatgtttgagtgcagcggatgcatgggcaaagcattacacagccgctccatggaagtgacaatgagccttgtctttcacacgtaactccaggaaccaggggaaacaaaaccaattccacccagaggtacagacaaagaagagcaccctcccaaaggagcccgcatgataagtggccacggcgaacatcactgtgatcagtcagaaaggtaaataaaaatcaaagagcgttcgaggcagccgcattgactcaccttgcagacaagcaagcagagccgcagagcagtgacccgtgcccagcgcctcgcagctagagctggattggaatccagggctttgcaggcttcctgcttcactcaatcctctttctgttgcctctggcctcaaggtgttggccntgggaggaagtagcagattaaattccatgggcacgaagtccgtagctgacgaatacttaatatgttgcagtttcacagtgaaagttggcaagtccagggtgggaacatgcctcaagcagctgagtcttctggattttacttctgttctttgcctctcaatttttgattttgttatataaaaagcaaatcagtaactattgcattatattctgcagtgactcaacagcgacacttaattcagccaacccaaggtttactgaactgctcgtggtgcccgggaaccgtgctgggataggatacagggacccaacccagtcctgatcattagcttagccagagaggtaaactgactgacaatcaatctgcccagggatcaattactatggaagctcatagtgtgggcccctaacccagactgtgggtctgaggaggtctcctggaggtagtgctatcctaacagagacctgaagggtacttggaatccagccacagaatactatttaccatctcattttactctcatgagaattctccccactgtaggcaggatgggtgttgatttaa

SEQ ID NO: 40279 - DNA, 1098 bp, Homo sapiens
agaccaaggcaggattagagtttgggactttcagatcccaccccccgacctccggggaggagagagggattgaaggttaagttgatcttcaatggccaatgatttaatcaatcatgcctgtgtaatgaagccttcataaaaacctaaaaaaggacggggtttggagagcttcctgtaagcgaacccgtgaatggttccaggatggatggcgcaccctggaaagggcgtggaagctccgagccccttcccacagactttcccccatccatctcttcatctggtgttcatctgatagcctttgtaatgtccttaagtagtaaatccggaaaacagtggaggaagaagagaatcaccacatatcgtatttagaggtcctgcagaaagggcagagcgagtttcatgtttgagtgcagcggatgcatgggcaaagcattacacagccgctccatggaagtgacaatgagccttgtctttcacacgtaactccaggaaccaggggaaacaaaaccaattccacccagaggtacagacaaagaagagcaccctcccaaaggagcccgcatgataagtggccacggcgaacatcactgtgatcagtcagaaaggcaggcgagttattagcttagccctgaacctcctacttaatgtagaaccagtggtgatggttaacagaccctggctgcagtgacaagcctgggacctgctcgaggaaatccaattgaaaagcagccaagaggaacaacaagctagaaacagatgttccagctaccaggatgtgcacgcatttaacctgaacatgtagttggggtgggatggtagcattcgtttctaaatatagtgatttcactgtcaaattttcagcaatttctttaaaataagaagatgtcagaatgataactgctattaagggaattcagggtgtttggtttatctacccagtcttactaaaacatttcagttaaatcatccactcttaaactccagtctcatagcaattaaaaattatcttttaaaaaattgcccaaatgaaattccaacagttcatgtaattatttgatttaatattaccatgttagtaaaatatctttaagatagtta

SEQ ID NO: 40280 - DNA, 588 bp, Homo sapiens
agaaagtagaaatgggaagcaaattcactaattcccccttgtcagttagcaaactttctaaatgctttttgtgtgcccttgaatttggacatccccttttctacagtcagcctggaacatttataaagtggaagccactgaactgtctaaaggcctttagaaaattgtctaagcatctttgcaattgcctcttttcttccaaccctacccccacctgaccccttggatgtggaccacacatacgatgctatgccataagcatcaaacatttcccacttgtgattttatgccaaatcataaccatgattcagaacactaaagtgctctgtttcattctaacctagtttcctgtaaactacatacagtgatagtttcttttttgtttttcagagtggaggaagaagagaatcaccacatatcgtatttagaggtcctgcagaaagggcagagcgagtttcatgtttgagtgcagcggatgcatgggcaaagcattacacagccgctccatggaagtgacaatgagccttgtctttcacacgtaactccaggaaccaggggaaacaaaaccaattccacccagaggtacag

SEQ ID NO: 40281 - DNA, 415 bp, Homo sapiens
ttgtgttggcggccctataggaggggttttcaccagactgttctaatctttgctagtcttgaggtgtgcgaagatgactccccaatttttaattatagcttttacctctgtattgagctccaaacttgcatattcagctgtccacttggtagttccacctggatgtgtaatgagcatctcagatattacgtgaccaaatcaaaactttttacttcccacatctttgctatttattaaatggcaccaccgtctgaccagttactcaaataaaaacaaccatgaatcatcccagattcctttttctttttgaggcagggtctcactctgtcacccaggctagagtgcagtgagctgagatcgtaccactgcactccagcctgggcgacgaacggcgtgagactctctctaaattaat

SEQ ID NO: 40282 - DNA, 606 bp, Homo sapiens
taacacttaacaatttaatgaattacatcacaggtacactttcttaaacttggaggctccgcagatctgggtcatcttggatagctgcaaagaagcaaactgtggtgtttggcttctattatgtgtgtaataatgtctataaatattggtaaatgcccattaatgtccagtattctccagtcatcaacaaattctgtctggatgttcaagcttccctataaactctctcttcaatcagtagttttggaaaggtgctaccgaagcctgcaggttaatagagaaccctttcaggggctaccacgagaagggaggggaatgaaacatcaagtctgtggggctgtgatcctgatccagagttgttttgccaaaggtttcttttaattcaagttaggaaacctctgacataaacgattacagttagcagtgaagttagtatctatggttagtatgagtgtgtaaaacacattttgggaaccactgttttagcaaatggcttagctttaagttttgctactcctattgtgaactgatagctgtcactccaggttttttcttattgtattatacctgattttcccattaaacattaaagatgtttatttttaa

SEQ ID NO: 40283 - DNA, 679 bp, Homo sapiens
actggaggcctggccttcccttcttacttttaggtactctccatctgcaggggcctggactccacaagctcccagattcttcttcatcctgctgaggaagcctcaggagaaagcccagcacagggctggaagcttcgtgggcagttttaaaataggtgaagagctgtcctagaggagagggagcacagaggttgacatcaggacctgggaggagaagttgtgaggcctgggcttgggtgtctggaaacccagggtttctgttaattaacagctgtgtctctttaggcagggttcatcaccccacgagccttggctttctcatgcttaagatgggtgcaaggatacaccctcagagttccattatggggatagattgaggggattcctctcaagtgcttagcaaagggtctggcacacagcaagcattcagtaaaaattaactgctgatgttgttgtacttaaaatttttctaatggctagagccatgtgtcaacagagggtccccttagtaggaaatatttaaacagaagttgttcctgcctgtgatagaaacaatttctaaccaagtgtaatttgttacctctttgacctgtagtcatgtctgtgtctgccattttatgctgagtgagtgattttacagggaaaaagaaaagtaagagtaataaacaggaaaaaaaaa

SEQ ID NO: 40284 - DNA, 213 bp, Homo sapiens
gctgttcctattggcgactgcacaattcttagcaacactgaagtgctggaggtgaagctctccgtgtgttgtcttcagatgacgaatgtattcttctgatgacttgggacaaattctccctccaaaatgccactgtctgtgaatacaccctcctgtaaaactctggccatagtacagggtgaaaggttttatggacaaaaaacaatgttgcag

SEQ ID NO: 40285 - DNA, 234 bp, Homo sapiens
catttctgtagagagaagaaaggggtgtgtgtgtgtgtgtgtgtgtgtgcgtgtactatgatgatatacaaaaacatgtctgcaagggttcataaaaaactcaggagagagtaacagggtggctgggagactcttcccttctgtatcttctgagttttggactatgcgaatgtatcatcctttcaaaaagtgaacaaaagattaatttccccctcctatctgtgtccccacccc

SEQ ID NO: 40286 - DNA, 413 bp, Homo sapiens
aaatgtccaattatcttaacacacaaatgttagctataaggggccttttgtgttttattataccaagttgttgctagctctaccttattaaaatcttcagttttaaaggctgaaagatcaaaaagagataaaaatgtattaatgctgattgttaaccaaccagtaagtatttattaagcatcttctatgggcttggtaacatattaattgagaataaggaaacattaagatataatactatttttattgagttgattatgtgccagctatttgcacacatttatctcacttaatttttacaattgccaactgaagcccagagagattgacttgttcacagtcactcagccagtaagtggtagagccatgattcattcaaacctaggtttgtctgacctcaaagctcattcttt

SEQ ID NO: 40287 - DNA, 392 bp, Homo sapiens
tcatgattaaaatatcttacctttctgaaaatataaatatttttgtcttttttgcccaacatagtctgtttcctgcattttattttcctttctgttttgaactctattactcagatttttcaggaatgagctatttcttcatatttaagaattgaagacaaaaagactgattggggtcaggtgcggtggctcacgcctatcatcccagcactctgggaggcctaagcaggcagattgcttcagcccagcagtttgagaccagcctgagcaacatggccaaaccccatctctacaaaaaatacaaaaattagccacgcgtggtggcatgtacctgtagccccagctaccagggggctgaggtgtgaggatcacctgagcccagaaagtcttgg

SEQ ID NO: 40288 - DNA, 278 bp, Homo sapiens
ttcacctcattaccattttatgtgtatgatgaaaatgtttaagatttactctcttagcaaatatcaagtttacagtacagtattgttaattacagtcactgtgctatacattagatctacaggactttctcccagatccatagaatttctccattatgtaaactccaaaagaatgaaattctgtggatgaagccttaattttactcttgataattaattttagttctgataatttgtgttaaacaaaaaaaataggagggcttgttttgctgcatagt

SEQ ID NO: 40289 - DNA, 92 bp, Homo sapiens
gtaaactgcagcctaagggagttacttcaataggccagtttcctgacaaaggtcgaatcctttctcatcagaatttaaaaattatagaacat

SEQ ID NO: 40290 - DNA, 372 bp, Homo sapiens
caaatccctggaactttaggtatgagccaccgcccctggcctccatgtttttgcctacccttcattcccaatgtcgaccctagataataattatgctctattctgaataagtttatcccatcacattttttaaaattgagaggaaggaaaccaaagtaatacagatgaatatgtattaatacaaaataatgtaaaaattgtagtttttagtatctccatatcatgttctgttgatagagtgtgttggtgcacacctgtaatcccagctactgggaaggctaaggcatgagaattgcttgaactcgggaggcaaaagtttcagtgagccgaggtgatgccactgcattccagtctgggcaacaaagtgagact

SEQ ID NO: 40291 - DNA, 398 bp, Homo sapiens
gaattcctgcctcagtctctgcttctgggagcccagcctaagcctttaagagtgggttcccactgtgagccgtcgtaatctggagtagggttgtggagtttgacagctagggaagaactggaggtgatgatgctagctggggccatccaggaagggtatcaatagagtcctgtgaagaaacacatcttagaggggaagcaaagtttgatgttacctctgtctcactctaaagcttggatttgtaaccatgaccttgtactattcttcactctctgcttataatattttttgtttctgtttttgatagagtgtcttgctttgtcacccaggctggattgcagtgagctgagactgtgccactgcactcaagcctggatgacagagcgagactctgtcta

SEQ ID NO: 40292 - DNA, 568 bp, Homo sapiens
ttcccacatgcacagtccaaagacagccacagctatctgctctgccctagttcaaatgaagtctcaggagtttagaaattgtctgaggtgctttgacttctaatttaatacttttagggtttttttgtttttgtttttggtttttactctctgtgtattcatttgtttaaatagttaatatggtcatggttatgagagaataaaattcaacttagtgtacaacaaaatatggattccaggaagcttagagggtggctaccagtgagacaatgagcagtatccccccagggtgggcagcatgtcgcacatctaaaatttgtggggtttttttgtttttttaagacggagtctcgctgtgtcgcccaggctggagtgcagtggcgtgatctcggctcactgcaagctctgcctcccgggttcatgccattctcctgcctcagcctcccgagtagctgggactataggggaacaccaccacacccagctaattttttgggtattttcagtagagacagggtttcaccgtgttagccaggatggtctcaatctcctgacctcatgatccacc

SEQ ID NO: 40293 - DNA, 491 bp, Homo sapiens
ttcccacatgcacagtccaaagacagccacagctatctgctctgccctagttcaaatgaagtctcaggagtttagaaattgtctgaggtgctttgacttctaatttaatacttttagggtttttttgtttttgtttttggtttttactctctgtgtattcatttgtttaaatagttaatatggtcatggttatgagagaataaaattcaacttagtgtacaacaaaatatggactccagcctgggtgacagagtgaaagactccgtctcaaaaaaaaaaaataaagaaagaaagaaaaagtttttgtcaaagtggatcaaaagacaagacccaactctgttgtctacaagaaacccactttaatatagacacaaatagatgaaaagtaaaccaacagagaaaaatatgccatcctaacactaatcaaaagaaagcaggaggagctaacttaatttcacagtggactttaaagcaaggaaagttattaggga

SEQ ID NO: 40294 - DNA, 343 bp, Homo sapiens
tcgacagataccttgagaccataagctagcatacctaaggacaaaaatataatactttaaggctgatagagcagatgatactgttgaatttctctatcaaatatagaaagatttgccccttgatttcttattttttaaggtgattaaagtctttattgtctaacatctagccaaatattctgttacttgtagccaaaagcattcctaggtataagttcataaaaataaaataatattttaatatgacttatagtattttaaaatattatacaaaatattaataaaagcctcattagaaaagcttgttacgtctttctataacttcatttatggataaacaatg

SEQ ID NO: 40295 - DNA, 226 bp, Homo sapiens
ggagaggaaaatgggaggtgggaatttactgggtccttactgagcaccagggagcaggattgctgtgggctggcttccatggatctagcctgcacctcagcttggctgcgtggttacctgagatgctcacaggagggagttttaattcagtgatacccttcctggggctcacatcttttattttatttatttatttatttattgaccagagtctcactctgtcacc

SEQ ID NO: 40296 - DNA, 606 bp, Homo sapiens
  misc_feature (28)..(29): n is a, c, g, or t
gagaatctcagctattgaagacttagtnntcaagtccaagttgaataaaccaaccacgaggagctgaagaatctggatggagaccgcgtcagatcccataggttgaggggtgagtcccacaagactagcctccattttagataccaaccacaagaatcaggttgttttacctgtagttctaaccaactggctattaatcagggttcccatgaccccctccttaggttctattaatttgctagaccaattcacagaacttagaggaacttagaggaacactttacttacatatactggtttattataaaagcatattacaaaggatacagatgaagcaatgcatagggcaaggcatgtgggaagggcacagagcttccatgcactctctggggcaccatcatccaggaacctctcatgtccacctatccagaagctccccaatcccagtcttttggatttttatggaagcttcattacttagacatgactaattaaaccagtgacgctggtggtcatcagctcgtctgccttctcctctccccagaggttggacattggttgaaggtcccaaccctctaatcctgcctgggtctttcaagtgaccag

SEQ ID NO: 40297 - DNA, 1355 bp, Homo sapiens
cagcacagtaaggtggatattatagtcttcttctagatgaaaaattgaggctcatagtggtcttgctgctgtgtcatagcaatagaatgagagagccttgcttccctgagtccaaatcccatacttttggcattgttatgaggtctggtcacctgatgcttccatgctattttcccatttcttatctggggataatgagtcatattaagtaatttttttttttgagacggagtttcgttctgtcacccaggctggagtgcagtggtgcgatcttggctcactgcaagctctgcctcccgggttcatgccattcttctgcttcagtctcccgagtagctgggactacaggtgcccaccaccacgcccagctaattttttgtatttttagtagaatgaggtttcaccgtgttagccaggatgatctcgatctcctgacctcgtgatccactcgcctcagcctcccaaagtgctgggattacaggcgtgagccattgcacccagccattttttttttttttaagacgacgtctcactctgtcacctatgctggagtgcagtggcgtgatctaggctcattgcaacctctgcctcccaggttcaagcgattttcctgcctcagcctcccaagtagctgggattacaggtgcccaccacctcgcctggctaatttttgtatttttagtagagatgaggttttgccctgttggctaggttggtcttgaactcctgacctcaggtgatccactcacctcagcctcccaaagtgctgggattacaggcaggagccactgcgcccagccaagtaacttttaacagtgtggtataacctttaaatgacaaggtgatgcttttgacttgtcctcaactttgatttgtactgatttgtccctatagttctgggtggggtgggtcaaaacaaagtctcgagctgtaccaggatcaagcagcacagctcagccatgatccttttaccacttttttcttctgtccttgagactctaattaaagcactggatttttaaaaatcacccttgtaaatatgcacacatttgtctatagttgaggaaattgtgccgttgaagtccattcttggacatggagttaagaaaccctggtttgagaaaaagccccagtgagacagcaggaatccttttaccatacaaccctcaactagtttagtgtgctcaagctcaaataaccaatcccatcaagtgaaaagaatggcagcagggagaaggcctggctcactgaggctctcagcattagtttcctctacctcttgtgtctcacaggtgcacatatgtacagcatatcaaagtgttgaatgtcatgagaataaaatatgaaaactactt

SEQ ID NO: 40298 - DNA, 547 bp, Homo sapiens
tgctttatatatacttacttttttatagataacagtcttttgataaaatacattttgctagagaggactctcagaagaatgtggggaactttgcttggttataggttgatcattgaagcccagtggaattttgcccaactcttttattatacatccctcagttttattgtcagaaataaaatgttatgctgaatggtaagagcctaaaataatacaacattcctttatacaatgtacttggtcccaacttgattgtgatgtcagaaataaacaatatttaatcattttccaaggagctggtctcccttgaaccagccccttgcagtcattgttctcctgactgatgttatcagagatcctatgcaggatctaattcctactcatgccagagcaagccaggagaagctctaccaactcctgggagctacaaagcgataggttcccagagtctaaaactattggaaatgatgtttgtctaaaatggccagagacaacttttataagcttccaggaagtggagaaccagaaaaactgagaaaaaaaaaaa

SEQ ID NO: 40299 - DNA, 565 bp, Homo sapiens
tactcggcacgagggaagaaagggcatcaggaactagggatatagacaagtttcttgaaagtgggaatacttggaattgtattaacagcttaaatcacattcacaggagaaggctgcagtagaggctagagctatttttcctggcaacagacccagagagaagctcaacacttggagtatgaaaggagagttggaaagaaatcaactgtggaataactgcgtgagtcatagtccatgttctccttccctgcatcacatgctcaggctaaaaccagaggactaatatttaaaataattgaatagtcttcgtgagaaggagccctagttggggtgatgcctcatctgagtaaacttcttcccacttttgctgggaagtgggagaagtagggagggggacctccaacctcctcttctttcactacaaggtctaaagcaaaggctgccagtgacagccacttgtgtagacaagagagagctggacaaggccgagctatctgcattgaatgaggtgacttacctcagttgtaggtatgaatctatagccaaggattatgaaaacctgaag

SEQ ID NO: 40300 - DNA, 369 bp, Homo sapiens
catccgcagctcagaatgcaaaaatagatctccatgtggggatgtggcctcttttccccaagtgtggaccagatgtcaggccgccttgtgagtactcaaggaatgttacggcttccttcttcaggacttcactgcttctctccatatggagaaggctccctttccatgcacttcctggatctgaaaaacaagaacaagaaagaggatggctctaaagtctcaggaaatggacctttctatatcctcccttttaaaaagcatttgtatgtaggttttttaggtcttgctgtcaagtcggatacacagctgtcatctgttatatcggtgatttaataacataataaaaatttatagagaaccacaagctca

SEQ ID NO: 40301 - DNA, 1376 bp, Homo sapiens
actagaacttgaaaatatgagtctgtagcctactgagactgcttttgattcccgaaagcacagtagataaggtaatgaaaaacatgtaaacgagctgaaaagtctccactgtctagggctttgattttcaaagtgtgcttctcagctgggcatagtaactcacgcctgtaatcccagcactttgagagagcaaggtgggtggatcacttgaggtcaggagttcaagaacagcctggccaacatggtgaaaccctgtctctactaaaaatacaaaaattagccaggcatggtggcaggcgcctgtaatcccagctacttaggaggctgaggcaggagaatcacttgaacccgggaggaggaggttgcggtgagccgagatcacaccactgcactccagcctgggtgacagagtgagactccatctcccaccccactacccacaaaaaaaagaaaaaaaaagtgtttcttagaccaccagcattagcatcacttgggaatttgcttgaaatgcaaattctcaggccctacccagatctgtagttttctgattatgtataatcagaaagtctggaggctaggcccagcaatctgttttacaatacctccagttgattataatgtatgttaaaatttgcgaaccactggtctagggaaattatttcctaactagtgttttatttctgcttctattgagttttagcctaagtctcaatcgttgagtgcaaaattagcattattgcatagtggcaaggacatggagtcacacaggagctagttgaatcctgggtcatcaagaatttcagggccatgcatggtggctcacacctgtaatcctagcactttgggaggatcatttgaggtcaggaattggagtccagcctcgccaacatgatgaaaccccatctctactaaaaatataaaaattagcctggcatggtgataggcgcctgtagtcccagctacccaggaggctgaggcaggggaatcacttgaacccaggaggcagaggttgcagtgaaccgaaatcatgccattgcactctagcctggacgacagagcaagactctgtctcaaaaaaaaaaaagtatttcaggcaagttcacctcccatagtttcccatctttgaaatgatattaataacatctatctccatgtaagattttttttagaattaagtaagataatatgtaaagtgtctagtacattgctaggatcccaggtgtttgagaaattgcatctagcaatttttcttgttagcaaagagcgcccacctccatctgttctaaactcctcttgtttcttgaatgtatttgctgtcttttgtctctggggctttgtattaactgttatcttttggcatccaacctcctacccct

SEQ ID NO: 40302 - DNA, 1979 bp, Homo sapiens
gaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaagaagaagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactga

SEQ ID NO: 40303 - DNA, 1944 bp, Homo sapiens
ggcgtggcggcgggggatgcgcccctgcgcgagccagtgtcgcctgccctccttccgcacagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaccacttgcttggagtgtgtgcttgaaaaaaccagagcaatactgttgggtattgtatcaggcttcagtacaaactggtaacaccaatgtggatcctgacagctttcagttttagcaaaaatacacgtgaaatctgactaccatttaaaac

SEQ ID NO: 40304 - DNA, 1745 bp, Homo sapiens
  misc_feature (25)..(25): n is a, c, g, or t
  misc_feature (28)..(28): n is a, c, g, or t
ccactaggctaggtacgaggctggnttnaatcggccgagggagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactga

SEQ ID NO: 40305 - DNA, 1918 bp, Homo sapiens
ggcgtggcggcgggggatgcgcccctgcgcgagccagtgtcgcctgccctccttccgcacagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggggtctgtgcctgacactcgggctgtttgtccaagcagatctgaaatgggccgtgaggctggggcagcagcctcccggagcagggagtcagccctgtgatgcatcccatccaccctgtccacaggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactga

SEQ ID NO: 40306 - DNA, 3038 bp, Homo sapiens
ggcgtggcggcgggggatgcgcccctgcgcgagccagtgtcgcctgccctccttccgcacagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactgaaaaaaaaaaaaaaaaaaaaaaaaaaaaaaaaaaaaaaaaaaaaaaaaaaaaaaaaaaaaaaaaaaaaaaaggggggggggccccaagaagaattctccccacgggaggcggccccagactacgctccgggccagcacacgtgattcgtgtatgggccaaagaggcggccgcccaataataggggagcgggtatattatatacaagcgcaggagcagccgacgcgcggcgcgggctgaactacaacaaacaagctacagaagcgagaggagcaaaccaccggtgtaaactcggtggagagcctcactcttgtgtcaagtaagaacccccctccctatcaacttcgcgggagcgcgggagcaacaaccataagcttggagcgaacaaacaaaacccccccccgcagaacggaaaccttagacgcacagcgctcgacagagcgggacaacctatatcacacaacgacccccgcagcagcggcgtcccatctaacaaggcgcgccacacacacaccgggcgtcgcacctatctgtgtgcacgatggcacgcggagagaagaaactgtcgtggcgcgtctcaaccagcgagggactttatatgcctctgtgacagacacaaacaactcatctcttcacccaccgaggcggggtccctccggcggcagacgaaacacagcacccgctggagcaggtgggagggtccgcacgcgcaccacgcgcacgcccacccgccacccagccacccgctgtggcagcaggaacgcacggcggggacaggcgcgtgggcacgcgcgggtggtggtgggaggccggcgcagacgcgcgggacggaacggcgtgagtggtccggcggacgagcgcaggcggggccggagggagcagcgagacagagagcacgatctcgggccacggcgcgggcaagcgccagccgacggaggggcggcggtgagcgagaccaccggcaggcggggtggcggcgacgcggagcgagaacacaacaggcggaagcggcgggagcaacagaacggacgagcagggggccacgccgatacaatccgcacacgtgaccagagccacacgacgcactgcaggcctcagacccacaacacaacacacccgacaaggacacgacaaccgcccagcgcacaccaagcaacacaacaacgaagcatactacacagagcgtacagcggtacgaccgcgaccgcgcacacgccgcgccgcttggcatggcagccgccagaaac

SEQ ID NO: 40307 - DNA, 402 bp, Homo sapiens
gggcttgtgctggcccatgatggtgaggacaggggccccaggagggaggggtgccctgcacaaagtggccagatgaggagtccagagtcgtgcacttgggcccttatcctttctctagtgtgctggagtttgcagttggttagaactggatggagagacccagcttcagatcatcccagctccactactcagcagccctgtgacctcaagtgggctgtggtgcctctagagcaggtctgtgaggcagggaacccggagaggggtctctggccaccaggtggcgccggtgctccccaccgggcctacaggaatgagctgccgccacaggaattcaagccatttccacgtgggcaggacaggttaactgaggacttgcagggcttacccagacttcagccatcg

SEQ ID NO: 40308 - DNA, 1794 bp, Homo sapiens
ggcgtggcggcgggggatgcgcccctgcgcgagccagtgtcgcctgccctccttccgcacagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactga

SEQ ID NO: 40309 - DNA, 1651 bp, Homo sapiens
gaagaaaactccggcccccaagaaaaagagagggcatgggttgcggagccgacatcacggccggggtctttgctgtttagacgcctgggttcccggatcccagacacgcgcacgggcaggaagttagaccggagacagcgaggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactga

SEQ ID NO: 40310 - DNA, 1883 bp, Homo sapiens
gaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaagaagaagcccgggtttccgcttccctccgggcgcgagaagaggggagccaggccgagccccggccctaccgccgccgccgccatgtggcccccagaccccgaccccgacccggaccccgagcctgccggcggctcccgtcccggccccgcggtccccgggctccgcgccctgctgccggcgcgggctttcctctgctctctcaaaggccgcctcctgctggccgagtcgggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactga

SEQ ID NO: 40311 - DNA, 1881 bp, Homo sapiens
gaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaagaagaagggtctctcattcatcacttttatctgctatgtggcgtcctcagcatctgccttcctcacagcgcctctgctggagttcctgctggccttgtacttcctctttgctgatgccatgcagctgaatgacaagtggcagggcttgtgctggcccatgatggacttcctgcgctgtgtcaccgcggccctcatctactttgctatctccatcacggccatcgccaagtactcggatggggcttccaaagccgctggggggtctgtgcctgacactcgggctgtttgtccaagcagatctgaaatgggccgtgaggctggggcagcagcctcccggagcagggagtcagccctgtgatgcatcccatccaccctgtccacaggtgtttggcttctttgctaccatcgtgtttgcaactgatttctacctgatctttaacgacgtggccaaattcctcaaacaaggggactctgcagatgagaccacagcccacaagacagaagaagagaattccgactcggactctgactgaaggcctggcgggtgccttggcaacctgagccacacaggcctccacccctgcgcctcacaggggtcgctggcgttggagcggaggcctggacttctgagttgcagagggggctgcggacacagcaggccccctacagcctcaggttctgcctgagcccagcctaccaggcttgcccctcagctcagcactgttgaccacgctgcgtatgagggcatcttgggtatcccactccttctccccatttctgtcccacaggccttcagccctttaacgtctctgccaaaaaccagcacaaggagacaaagcagagccttgtctgtatctgggcagcaggtgttccatgctgctaggtggcgggggtcgggggtcttctgtttcactaacaggaacaaagacagaaaccatgacagggctgccccgccaggccccggtgggtttgtctgcacttggtgctcctgcccacaccagccactttggtgacaatgacccttccaagaatctttggttcaaggagcaccagttccctcttcattcttgaagcagggagaaattgacctttgccttgtcgcccaggaagtggggctcggcacccataactaacacctcccacccttggaaaccatgtcttctgggggtgagatgaccattctgggtctaagactgtttcaaagaagagctcatagactgactggtccagaagacagagggtacaacagtggcatcacagtgacagtgtcatggggagctgggcgggcccagccaaaccctccttcttcctagagcccagccagcaggcaggagttcctggaccctcaggacagtgaacttccagacctcagggcaggtctatgggccactgcaggagatgagaccagccttctgtgttcacctaacgatttatactgtgtatctgtctttgatggaattttgtaactttttatatttttttatgcaaaagcagcttcttaacagatggcattttctgtgactctaggcctcacaaaagagccagagttctggacccatgtttggagcatttgtagccttattctcttgcgtgtgaatctcttaccctgaaaaaaagccataatgaattaagccagactga

SEQ ID NO: 40312 - DNA, 2383 bp, Homo sapiens
ctcttctgtggcacttatacaaaatatctcttcacctacttagttctacagggttaactttggagcaacatgaataaaatcatcgagaaggccaatattgtttagcaacatgaatacaatacagtttaaagttgtacacatcctgctcaactttattcatgtacatttcctttctgtggttttcttttgcttcttagaaattctgttagtggttagtaaagaatttgaaagtactttctccttgctgttttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttttgtttcttgggtttttcctaaatttaagtgaggttgggcttaccttgtagataaaattatgttttctttttggtaaatacttgaacgtggataacgtcaaatcagaatattttgtgaggaggtgatgatttgaaattaagctagatttctagggaggtgttggttccaatgaaggatgggaagaaattaaaatagtcttcaaacttcttccttattatatttggttgctttggaaaagattggtcctatcctcaatctaatttattcactattaatattttaaaaacattcctgagatacttaaaaagacccacttagcgattatagttgctcaatgaaacaagaatttatttatgcatagatttttctctgtatcttaccaaaatccactttacttagataacactaaattgttcttaaagactactcatttcccaataatcctttatgatttcaaaatttctagtggctcagaagtgaattttattttatttgtctttcacttgaataaatgagaacccagaaattaataatgttgtttattgcttactgtcaggactatttcaaagactaagaagagtttcttctaacccctccctctcaaaggaatcctaaattattagttgttagataagttttgtatgctaagatattcaggtttatagtttatgtatgtgtgtatatatataaatatatatgtatatataaatattatgttcagtttggagtctggcacaactccattatgtggattagagagtaagatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacatgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggaacaaacaattgtattgtatttgttacagattgtatatggctttgttttaacattcccctaaataaaatggcttcattctccccttggaaaaaaacatga

SEQ ID NO: 40313 - DNA, 4174 bp, Homo sapiens
  misc_feature (564)..(564): n is a, c, g, or t
  misc_feature (623)..(623): n is a, c, g, or t
  misc_feature (701)..(701): n is a, c, g, or t
  misc_feature (935)..(935): n is a, c, g, or t
  misc_feature (1365)..(1365): n is a, c, g, or t
aagggaccggcacccagggacagggcgggcgcccggggcctgcgcccctcagcggtatctggaaatatttttggttgtcatgatggggtggggtacaggccaggggtgctgcttagcatctggacagcccccactatggagaatgatgaggctgagaaagctccccaggccggggctctcctgtgaggcaagtctcctggcagtcttcaggtgtggcaggggttggggtgggcccgggggtcatgtcccagctcagctggtcctgagaagctgcctggtagacagtcaccggcacagagagctggaaagtgccctcgaccccagaacctgggtcctgtgaggacatccaccctgtgtgaggccagggagtgctcagcagatgggggcagcagggggtgtcagcatgggtgggggttcctgccaaggcaggcagctgagctggccccacctcagagtgcaggggccctcagcttgatcttttctgggctccactcttgactgatggacccatggggcaccctggccccaccctgcctgccttgccccagctcctgcccttgcccngtagggctctgcggcctcccctgtgcctgtgtgcctggctcactagaccctggacctgnggtccctcagctccactctagtccccttactctgtccctctactgcctggcgtcgctcagctcctccctgcctgtccngcgcccagcatcctgtgcccatgacctcacatctgtccctctgcccgggtcccccactcacctgtgttttggtccatctttgtctgctgaccccactatagattttaaaaatacaaatatgcatgcacgtggttaaaaactcgctgatgtcagatggctgggatgaaaggactgcctgctgcctttcctcttgtagtgctcggacacctctgcaggcgaagctccttgtttttnttttttgttgttgttgttgttttttcacttcttattttgaaataattatagattcacaggaagttgcaaaaaaaaaacaaaacaaaacccgtgggagagatcgcacggacccctccccagttcccctgattgcacacacagggcatatctggggtctctggatttgtgtgtcttactttgtgcgtctgtgcacgcatgtgtataactgcagttttatcacgtgtgaatatctgtggccattctcaggcccacgcggcttcctgctcctgcccctgaatgggcacccccaacaccccaaaacctgttctcagctgtaaaatcgtgtcatttcaggagtgtcatagatggatgcatcggcctgtcactttttagccttacccttttccctcaccatagtgccctcagatccacccacttctgtccatctccngctccctgttcttgctgagaagtcccacatggtgtagtggcaccttgattctccctttctggctgttaccagtatagctggctgctgtgagctttcgctgcaggttttgtgtgagctgcagtcttcgtttctcagtgatccatgcccggaagtgagagggccaggtcgtggagtagttgcttgtttggtgttgtgaggacctgcaccctgtcttccagagggccacccgttttgcctccccaccagcagcatgccagtgacctggtttctcctcatgctggccagtgttcaggttcaccactgcatctgtctgggccacatcgcctgtgtttccctggtggcgtggtgacctttccgcggcacacctgcggctgcccctctgtgctgtccttgctgttcctcccgtcatcttagcccacgtgtgtaaatgacatatgttcccctcccttgtgggtgttgtttttgatgtcctgtgaccgctgtcctggagtgtgggccagattcactggctgtcacagctggctatgcccaccctccctgcggcagggtcctcagtgagacctgtgcctactggttctgggtgatgagcgtgaacgttctccgtggctgctggcacgtgggcatgaccacagggtagagtgagactgcagagatgagggcagcaggcccctgcttggcacctgaagccctgggcaactggcaaggactgagccctctcctggctggaaggggctgggccacctgctcttgggcttgtctctggaaggccctctgggggtcttactacctccctgtctcagctcccaccagcctgtgaagccctgtgcagtccatacctgcaatcaaccccagccatggaggtggctgtaccccaggtgtctccacttagtgcccccccccccgacatgccccacgctgcccagcctctcctcttcccaccatccgtctggtcaggggtcattcttgtggtgcctgcccaaatcctctgaggagggctgcctggagtgcaggctccaggaacactcggaggtgtctggcttccttctggagtgtgacagctcggtgcagggcgcgctgcagaagcacctcgcgctatacaggatccggcggaaggtcacggtggagccgcacccggagctgcgagtgtgggcggtgttgcccagttcccctgaggcctgcggggctgcatcgctgcaggagagggcaggggctgccgccatcctcatccgcgacccgcgaacagcacgcatggggtggcggctcctcacccaggatgaaggcccagccctggtgcccgggggccggctcggggacttgtgggattatcaccagcaccgatacctgcaaggcgttcctgagggggtccgagacttgcctcctggggtggccctgcccctggagtccaacctggccttcatgaacggcgtgagcttcaccaaaggctgctacattggccaggagctgacggcccgcacccaccacatgggcgtcatccgcaagcgcctcttccctgtccggttcttggacccccttcccaccagtggcatcacccctggtgccacggtgctgactgcctcaggacagactgtgggcaagttcagggctggccagggcaacgtggggctggccctgctgtggtcagagaagatcaagggtcctctgcacatcagagcctctgagggtgcccaggtggccttagccgcatctgtgccagactggtggcctacagtctccaagtagtccgaagccttggctggcgcaggctgatggggaggctggggcctggggcctttggcctctgtccagggtcttcccgtcccatctgtctgctgcgcctactgggtgggagccctggtttccatctgggaaagtcccccttgtaggtgccctgcctggccccacccatgctcaggggccccaggcacgtgggttgttttctccctggacttcctgtggccccagaggagcccaccgtgtgagtgctgggctccagatggcgccgggtcccaatcgtggctccacacagggttgtctgggaggacgggacggtgtctctggccagcactggcagcttccgggccttgtaccccactctgcctggcatgagcctcatggggggttggtccctgtgcctggaagcggggtggtgtccagggtctgcaggctggggctcgggctttgggagttgtttcactgtgcttgcttccagcatgtctcagggtggggctatgcgtggtctagaggggtctggggcattggatcaggtggcatgtgggtgtctacacatcgagaagcacacagggatgagccactaggtatcccatgctggaggcttgtggaaggctgtgcccatctcccatgtttccccacctctgttcctcctcagagccctccaggagcgtggggtgggggccagcgcagggctcaggagccagcagggcagagttctgcctgtgtgtgctgggttttggcatagcctgtgtttgcagtgagagtgacttgctgtcagtcacggggcacagcctcctgttcacccactggcttcccccttcccactgaagtgtgagctctatgtttcagggcatctattaaagagtgagccacaggcagccccttgggagctctggtttcatttgggggagagggaggtgggggcttagtttttgtgatctggctgactggaccccgggaacagcgctcctttgagaacgcccagacctaccagatgaagcacttggcatggctgcaggccagcaggggaggcctcagaggcccaggctgggcacgtgggtgccgagtctgcaaagga

SEQ ID NO: 40314 - DNA, 2291 bp, Homo sapiens
  misc_feature (125)..(125): n is a, c, g, or t
attccccgcgcccttcccgcccggcaccccagttctgtatacataaacggccaaggtgtgtgccaaaaaaaacaaaaaaaaacccgtttgcggccgcgggggccccgcctgctgcgcgcgcgggntacgcccacttcctgaacgtgcagggccggacgctctatgacgtcatcttgtacgggctccaggaacactcggaggtgtctggcgctggcggctgcgcgcggccccaaggtgccgcctggcccacagctcctgcagtcctggtggcgacccaacggccggagcggcctgggcctgcttccggctggacgggcgcaccctgctgcgcgtgcgtggccccgacgcggcgcccttcctgctagggctgctgaccaatgaactgccgcttccgagtcctgcggccgcgggggccccgcctgctgcgcgcgcgggctacgcccacttcctgaacgtgcagggccggacgctctatgacgtcatcttgtacgggctccaggaacactcggaggtgtctggcttccttctggagtgtgacagctcggtgcagggcgcgctgcagaagcacctcgcgctatacaggatccggcggaaggtcacggtggagccgcacccggagctgcgagtgtgggcggtgttgcccagttcccctgaggcctgcggggctgcatcgctgcaggagagggcaggggctgccgccatcctcatccgcgacccgcgaacagcacgcatggggtggcggctcctcacccaggatgaaggcccagccctggtgcccgggggccggctcggggacttgtgggattatcaccagcaccgatacctgcaaggcgttcctgagggggtccgagacttgcctcctggggtggccctgcccctggagtccaacctggccttcatgaacggcgtgagcttcaccaaaggctgctacattggccaggagctgacggcccgcacccaccacatgggcgtcatccgcaagcgcctcttccctgtccggttcttggacccccttcccaccagtggcatcacccctggtgccacggtgctgactgcctcaggacagactgtgggcaagttcagggctggccagggcaacgtggggctggccctgctgtggtcagagaagatcaagggtcctctgcacatcagagcctctgagggtgcccaggtggccttagccgcatctgtgccagactggtggcctacagtctccaagtagtccgaagccttggctggcgcaggctgatggggaggctggggcctggggcctttggcctctgtccagggtcttcccgtcccatctgtctgctgcgcctactgggtgggagccctggtttccatctgggaaagtcccccttgtaggtgccctgcctggccccacccatgctcaggggccccaggcacgtgggttgttttctccctggacttcctgtggccccagaggagcccaccgtgtgagtgctgggctccagatggcgccgggtcccaatcgtggctccacacagggttgtctgggaggacgggacggtgtctctggccagcactggcagcttccgggccttgtaccccactctgcctggcatgagcctcatggggggttggtccctgtgcctggaagcggggtggtgtccagggtctgcaggctggggctcgggctttgggagttgtttcactgtgcttgcttccagcatgtctcagggtggggctatgcgtggtctagaggggtctggggcattggatcaggtggcatgtgggtgtctacacatcgagaagcacacagggatgagccactaggtatcccatgctggaggcttgtggaaggctgtgcccatctcccatgtttccccacctctgttcctcctcagagccctccaggagcgtggggtgggggccagcgcagggctcaggagccagcagggcagagttctgcctgtgtgtgctgggttttggcatagcctgtgtttgcagtgagagtgacttgctgtcagtcacggggcacagcctcctgttcacccactggcttcccccttcccactgaagtgtgagctctatgtttcagggcatctattaaagagtgagccacaggcagccccttgggagctctggtttcatttgggggagagggaggtgggggcttagtttttgtgatctggctgactggaccccgggaacagcgctcctttgagaacgcccagacctaccagatgaagcacttggcatggctgcaggccagcaggggaggcctcagaggcccaggctgggcacgtgggtgccgagtctgcaaagga

SEQ ID NO: 40315 - DNA, 2143 bp, Homo sapiens
gagatggcgaccgcggcgctgcttcgaggcgccactccggggcgcggcggcccggtctggcgctggcggctgcgcgcggccccaaggtgccgcctggcccacagctcctgcagtcctggtggcgacccaacggccggagcggcctgggcctgcttccggctggacgggcgcaccctgctgcgcgtgcgtggccccgacgcggcgcccttcctgctagggctgctgaccaatgaactgccgcttccgagtcctgcggccgcgggggccccgcctgctgcgcgcgcgggctacgcccacttcctgaacgtgcagggccggacgctctatgacgtcatcttgtacgggctccaggaacactcggaggtgtctggcttccttctggagtgtgacagctcggtgcagggcgcgctgcagaagcacctcgcgctatacaggatccggcggaaggtcacggtggagccgcacccggagctgcgagtgtgggcggtgttgcccagttcccctgaggcctgcggggctgcatcgctgcaggagagggcaggggctgccgccatcctcatccgcgacccgcgaacagcacgcatggggtggcggctcctcacccaggatgaaggcccagccctggtgcccgggggccggctcggggacttgtgggattatcaccagcaccgatacctgcaaggcgttcctgagggggtccgagacttgcctcctggggtggccctgcccctggagtccaacctggccttcatgaacggcgtgagcttcaccaaaggctgctacattggccaggagctgacggcccgcacccaccacatgggcgtcatccgcaagcgcctcttccctgtccggttcttggacccccttcccaccagtggcatcacccctggtgccacggtgctgactgcctcaggacagactgtgggcaagttcagggctggccagggcaacgtggggctggccctgctgtggtcagagaagatcaagggtcctctgcacatcagagcctctgagggtgcccaggtggccttagccgcatctgtgccagactggtggcctacagtctccaagtagtccgaagccttggctggcgcaggctgatggggaggctggggcctggggcctttggcctctgtccagggtcttcccgtcccatctgtctgctgcgcctactgggtgggagccctggtttccatctgggaaagtcccccttgtaggtgccctgcctggccccacccatgctcaggggccccaggcacgtgggttgttttctccctggacttcctgtggccccagaggagcccaccgtgtgagtgctgggctccagatggcgccgggtcccaatcgtggctccacacagggttgtctgggaggacgggacggtgtctctggccagcactggcagcttccgggccttgtaccccactctgcctggcatgagcctcatggggggttggtccctgtgcctggaagcggggtggtgtccagggtctgcaggctggggctcgggctttgggagttgtttcactgtgcttgcttccagcatgtctcagggtggggctatgcgtggtctagaggggtctggggcattggatcaggtggcatgtgggtgtctacacatcgagaagcacacagggatgagccactaggtatcccatgctggaggcttgtggaaggctgtgcccatctcccatgtttccccacctctgttcctcctcagagccctccaggagcgtggggtgggggccagcgcagggctcaggagccagcagggcagagttctgcctgtgtgtgctgggttttggcatagcctgtgtttgcagtgagagtgacttgctgtcagtcacggggcacagcctcctgttcacccactggcttcccccttcccactgaagtgtgagctctatgtttcagggcatctattaaagagtgagccacaggcagccccttgggagctctggtttcatttgggggagagggaggtgggggcttagtttttgtgatctggctgactggaccccgggaacagcgctcctttgagaacgcccagacctaccagatgaagcacttggcatggctgcaggccagcaggggaggcctcagaggcccaggctgggcacgtgggtgccgagtctgcaaagga

SEQ ID NO: 40316 - DNA, 469 bp, Homo sapiens
acccatgtaaccgccgccaggggtcggatcggcttcgctcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40317 - DNA, 604 bp, Homo sapiens
ggacttcgctggagagatggcaccggcctgaggtcaaggagaaattgaactaaactctcctttgaagactgtttccagaggcccgttcccgaagccggagtcccgacccgaaaccgtccccggccggctcgctcgctcagcagggcgcggctccagcgccacccggctcgccccgaagagcagcgctggggcagcggagagacagaggagccagcgggtggccatggccttggcgtgacagagcctccccggcggccgggcgggtgcggacggcggggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagccccacccttttccctccccgggggcacgcgcctcctcgcacaacctcagccgggcttttcccaggctacgccctcctccccacgccccctgctcgggctgcagttcctataggaa

SEQ ID NO: 40318 - DNA, 4451 bp, Homo sapiens
ggacttcgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctcaaaattacagtgttcattgtcattgacctcaggcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40319 - DNA, 4330 bp, Homo sapiens
ggacttcgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagagttcgcagatttccgcccaccttccgcctcgtctagccgcgccacagctagcggggtgatctttccccccctctggtaggagttggtgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctcaaaattacagtgttcattgtcattgacctcaggcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40320 - DNA, 2898 bp, Homo sapiens
acaacttttatactgtaagatcatttaaaccagtaaggacatttttaatattgcataagtataatacaagtacaaggcataataatattatagaaataagctagaatagctacacacacgcacacacacgcacacacaaagtacattatatccaatgcatcacttctgtgtttctatttttttttaatgacttatcaggacgagggaaaattaactttctactttaactgaagtttgttattcttgttaccacttctctgtgtatatagatctgttgtcagtgttctctttttaaactatgtatttctacatttttatgacatgtttatcttaattgcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctcaaaattacagtgttcattgtcattgacctcaggcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40321 - DNA, 4193 bp, Homo sapiens
ggacttcgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctcaaaattacagtgttcattgtcattgacctcaggcagcaaatttgacttgaatgagagagagagagggggagagatatagagagagagggagagagagagagaaagggttcatgtcagcatatacatattatgaacagatgtatgcggacacctgtgcgtcgaatatctcattccagagttctgcgcatttatatgttggtccccccctttggtgctataacagcctccactcttctgga

SEQ ID NO: 40322 - DNA, 1682 bp, Homo sapiens
taaagccctcattgtcacgatgttaaaactgtaccaaaatattactctgcataggtttcctttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctcaaaattacagtgttcattgtcattgacctcaggcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40323 - DNA, 2343 bp, Homo sapiens
ggacttcgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcaggttagtttttgatggaactgtatgaatcaggtagtgttttgttttttgatcaagtaaaacaaaaagctggttagtgttaatacatatggcactgccttaaatttctttatttttaaaataacattttccatcacacaaaatagtcaacattcaatgaagaaaatttttttaaatgcagataagcaaagcggagataagaaattgcttatattcccatcaccaggattttaagtgagttattgttcttccttctctgctttattggtaatatttctttgggttgagttaaaccataatacactttttccctgttcttctgatttagcatccagaatgcacaggagagcactgagtaataatttcagaagttttgtggtattttctgtacttttatgtttttatgtcctgagcaagcaaattgctgcaattaaaatcaccaatttactaatc

SEQ ID NO: 40324 - DNA, 579 bp, Homo sapiens
tgtcagggaaacccttccgggtgtgtgcttggtgggggtgggggtgggggtgggggtgggggtggggggtgggtgagaaaaaaaagaggtgggttcgcctggagtccctgcggccgccgccggacggcccccgcctctttccccgcggcgagcagcagcgctggggcagcggagagacagaggagccagcgggtggccatggccttggcgtgacagagcctccccggcggccgggcgggtgcggacggcggggccggacgacccccgcgggagccggggcccagaaacccgcccgggcagcggtaactggaacggagccctcaggcctgagccggctgggctgcgcgagcaggaagcggggtccctgggcccctttgtgtgaagggcgggggaggagtgccgggcagccccgggctgcgggctcctccgacgtccgcctcgccgcagggtcccctcgccgcagccccacccttttccctccccgggggcacgcgcctcctcgcacaacctcagccgggcttttcccaggctacgccctcctccccacgccccctgctcgggctgcagttcctataggaa

SEQ ID NO: 40325 - DNA, 3297 bp, Homo sapiens
acttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctcaaaattacagtgttcattgtcattgacctcaggcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40326 - DNA, 4228 bp, Homo sapiens
ggacttcgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggatgaagcactggtacgaggtaatatacagaagtaaccatttgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctctctctctctctctcaaaattacagtgttcattgtcattgacctcaggcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40327 - DNA, 4437 bp, Homo sapiens
ggacttcgctggagagatggcaccggcctgaggtcaaggagaaattgaactaaactctcctttgaagactgtaagtgacattggggaatactcagggagggacagtgggacctcacactactatgattcgcctgtgttctaatgtccaacaatttaggctgagtaataaatctctttatagagtttggccatttagggcttgtaagtaagggaatttggagtcatttttgctaggctggccactgagtctcgcaggtttctgggtacatgcttgaattgaaaagaaagtgacacacctaaaatacagcctagactcctggccctggggctctgtggatccgacacaaagtttacaaatagaaagctagcaaagggaaagatagtcggaagtaacaattttatctaaaaatagaaacttagaatctaacaccagagttactacttgcttttgaatttcaaagactacataggatggcctttaaaacaaaacttcagcatgtaagagccagccaagcaaattgttatacataatcaacgattaaaataaattagtctttaggcctaaaccgtttccaatcaaatctttcttgaatattggttaccttttctgccgtgtagtggttggaatcaaatgagaacatagctgagcagagtaccataaagtctacttctaatgctgctgttttcgagccttgtgatttttttttaagtgactttagtattcgctggtaaagtcaaggcggatctaccagacggtaaaagttctgtgtgtttgtcaggcacggctaagtaaaacgcactgcatctgaaagtctaagggtagtttgcatgcatctctcagcaaaatagcaagtggaagaaataccagcaaggagaataaactttctgggctgtttgatttcccctgcaacttctagtccagggatgtttggcgttctcccggtcgctagattattagcccgcaggttccgcaccggccagggagccgctcaagtcctagggccgggcggctggaggttgcaggtcggaggggcttctacgggtttgggggtgggacggtccgcggcagccgcgggcgggtaaggactgacgtcgcaggtttccagaggcccgttcccgaagccggagtcccgacccgaaaccgtccccggccggctcgctcgctcagcagggcgcggctccagcgccacccggctcgccccgaagagttcgcagatttccgcccaccttccgcctcgtctagccgcgccacagctagcggggtgatctttccccccctctggtaggagttggtgaaggtgagactcatgagggaatacaaggtagtggtgttagggagtggaggggttggcaaatctgcccttactgtgcagtttgtcactgggactttcattgagaaatatgaccccaccattgaagatttctaccgcaaagagatcgaagtggactcttccccctccgtgctggaaattctggacaccgcaggaactgagcagtttgcctccatgagagatctctacatcaaaaacggccaaggtttcatcctggtttatagcctggttaatcaacagtcttttcaggatatcaagccaatgagagatcaaattgtcagagtgaagagatatgaaaaagtcccactaatcctagtaggaaataaagtggatctggaaccagaaagagaggttatgtcttcagaaggcagagctctggctcaagaatggggctgtcctttcatggagacatcggcaaaaagtaaatcaatggtggatgaactttttgctgagatcgtcaggcaaatgaactattcatccctgccggagaagcaagatcagtgttgtacaacttgtgtcgtccagtaaagaagataacctcaatcatggccataccgagcagataaaactcagaggaaatttgcacagatgctgctttggagaactttacaacctgggttgcagaactgagccttggtaaacctgtctctattacagcatgttgccatacatctatttaagtgcataaggtctttggccttcaagatccatcgaccttaaacaggaatgcttagcacgtttaccatacgtttaaaatccattctttatcaatcagtccttttatagctttctaagttcttattgatggctaatatacaagggttaatttttaatattttaattgatttctttaatcagtttctcgacttgtatttattaaatactcaaactcagtattacctactcaatgccttttaaaagaaagttataatggagaaaaaattgagccttaaacaaatggttacttctgtatattacctcgtaccagtgcttcatcctatttgtaaaatctttctcctttaaaattattggttaatactttgagactttgtttacgtgtggcagtgttgtaaaaagaaactaaagatcacattttacctgtatggatggaatatcccttttcttcaagtgcagtttgtgatgtgttttgtttttttttttttttttttgtaattaacatgttctgaaggttacaattgatatttgaaattgactgtagagcatttagttgaagagttaagcattcagttccattaggttttcacatgtgttaatctcatttacagcattgaattgcggcagtaacattttcctttctgtgaagttctaaatttagttatgacctatttagcaatgcctttgaaaagggatattgtatccatggtaaattaattgtatacctaaacagagatagctcatctttgcctatcaggcttgtaattgacatctagtagacttctgcacatgtaaaattgaattcaaataaaatcatacacactttctagttcttaatatttgtctttctgaataatagtttaaagcaatatttgttaaagttttcttgcactatcacaattgctttttagttatttctcaagaagcatgttcgtattagagacaaaatctgtgtaacaggagggagaatagcgccaagtctctgggctattttttatttttgcaaatgtgctttctaatagccattgccttccatgttgtttacctaatcagcatatttttgtctgaatacttgaacattttaacagtaacgcaggtgtagaatcagaaaggaaacttatgcagagtaatattttggttcagttttaacatcgtgacaatgagggctttttctagcaatgatttttaaattgtgtaagtttgacagtattttattgttgggtttttatttgattttagttgtgtgcttttcatttgcagaagttagtaactgcagctcacctactgcaccaaagttctcgattttaggagcccagctttagtcatttgaacatgcttctaaataaaataaaacaaaaccaaaactatacttttgatctataataagagctcaataactttgtcaaggaaagctctaatatatgcagtgatggtttatgaaagggtgtggcaattttaaatttatattgtgtgtgatgttcaaataaagtggtatctacattcatgtgatttatgggtcagcatgaccattaattactgagtagaaattgactaaactttgatttcctttttttaaatcgtgttgcatttgattcctgagcaaattccctcaaagtgaactcttgttcttaaattttgaattttatggtgagattgtaaagatagaggcaattgaaacattgttccttatttatgaactgcttgaagtgaatacttaatttaagtttgcactttaataccaaacttaaaaccaaacactcatttaaaagtaggttaagtgatcatggatcattgttattagctttgtggctttgtgaaattctaaaggaatcaaataattcatcatgatttaaattttctagagattttgatttttttataatgtttctttcctgtagattgtgttcttgtttctctctctctctctctctctctctctctctctctcaaaattacagtgttcattgtcattgacctcaggcagcaaatttgacttgaattcacttaggatcgcaggaatcaggggaaagtgattttaaaggtggtttctccagcacattttaagaaaagggaccaaaagttattttagcttcctcaatagattgcatgttgcttattaggataataaattaatattaaatgcaatatatgtcttgtctttattatggcatctatttaggagttgttcaaatcactgcagtagggctctgcaaataaaataatgtaacctattatcatggatctaatgtactgtaactttatcagtgaaaggtaaaatctcaaataacaagtacaaacattgaacaattacctataaagatttgtaaaagtaaaatttttccaatagatttcattcttgtcattttgtaagacgaccctgcagtccacctgtttgtaacttttttaataaaatagacatctgtattactga

SEQ ID NO: 40328 - DNA, 488 bp, Homo sapiens
tatactaaattcatataagcacagcccatatatgctttttccaagagggccagatacttagaatcataaaatgttatagcagaaaatgaccttggaaatcatctagttcaatccctcattttacagatagggaaattaagttctatagaggttaagtgacttgtcaaaggttagcgaccaataagtcgcagaaccagggcttaaacccatttcctgatcctttttctctactgaaatcaccattaatgatagtgccagagcagggctgcaaatgaagaaaggactgtcctacaacaggcacttcaaatagaatcctgtccaatgaatatgctattccttatattttctctgtgggcattaatctctggtatatatattcaaagcagatgctaacgacttcttttttaatccttgggcaattctaaattttcaaagaattaaaagggctgcttaaagaacataaaaaaagcaaatgagggttatttata

SEQ ID NO: 40329 - DNA, 796 bp, Homo sapiens
agtgtcgctttcagttgtaacggacttcatcacatcacaaattgtactcgttctcatccttttaagaaagttcagacccaggaaaatttccatagtaccttaatgaaaaagatagaaatcagtgggacgtgtctttcctttcatctccttttcggcttggaaatcagaatgagaaggattgtttttgctggtgttatcttattccgcctcttaggtgttatcttattccgcctcttaggtgttatcttattcggccgcttaggtgacctgggaacctgccagacaaaacctggtcagtactggaaagaagaggtccacattcaagatgttggaggtttgatttgcagagcatgcaatctttcactgcccttccatggatgtcttttagacctgggaacctgccaggcagaacctggtcagtactgtaaagaagaggtccacattcaaggtggcattcaatggtattcagtcaaaggctgcacaaagaacacatcagagtgcttcaagagtactctcgtcaagagaattctgcaactgcatgaacttgtaactactcactgctgcaatcattctttgtgcaatttctgagtcagtggcccatatctaaaatgcttggcagatcaatcagtctcgaagcctgacctggctatcacaaaatgatggctattgtcaattagcccacttcagaaacctcagacccttgtaggtagaaggaattttgatctgaaattgactttggttttcaatattcccaatatctcccccaccacctccaactcatctgagaaatagccct

SEQ ID NO: 40330 - DNA, 417 bp, Homo sapiens
aggtgttgtaacccataggctgtgagttccttgaagacagatcactcctctttgaatcttcttgtccacacaatgtctaacaagtgacactcttaacttgctcatcacagaagtgtttatcaaataattacatttgatattctacttttaaggagataagtattttgccatgttacagtaatgaatgggatggttattgaggaaaatagggggtaagtgaatgcttaccccaagtctacagttgagtctctgtggggataatctcttccctgaaatggcaaaatttgtaatgtggccgggcgcgttggctcacacctgtaatcccagcactttgggaggctgaggtgggcggatcacttgagctcaggaattcgagacccagcctaggcaacatagcaagatcccatctctacagaa

SEQ ID NO: 40331 - DNA, 263 bp, Homo sapiens
ttaagaaatggttaattgacaaagaaacattgaacttaaataggactttacagacatttacagaacactctaccaaacaactgcagaagaatgaaactagacccctacctctcaccataaacaaaaatcaaatcaaaatgaattaaagacttaaatctaagatcttaaactatgaaactagtacaaggaaatgtctggcaaactctcaaagacattggtctgggcaaaaatttattgaataataccccacaagcacaggcaac

SEQ ID NO: 40332 - DNA, 461 bp, Homo sapiens
gccttccttgtgtagaacaggctcccctcactgagctaggacaggtacacagacacagggctctgagtgtggggacgttggagtctatgtaccaagtgcttagggtcatagagccccactgcctgggtgcaaattgttccaacagtggggaccctgagcaagttccttaacccctctgagcctcaatatcttcatctgtaaattggggtgctagccctatctagtaggggttttgtggagattaagatcatttgtattggttcaaaatgggccggatgcggtggctcacgcctgtaatcccaacactttgggaggccaaggcaggcggatcacctgaggtcaggagttcgagaccagcctggccaaaatggcaaaaccgcatctctaccaaaaatacaaaaattagccaggcgtggtggtggacacctgtaatcctagctacttgggaggctgaggcagga

SEQ ID NO: 40333 - DNA, 432 bp, Homo sapiens
aaaaaaaggagctcactgaggtctcttttacaagggcactaatccattccatgaggtctccaccctcatgacctaaccacttcccaaaggcctcacctcctaataccaacattgggggttaggatttcaacatatacattttgaggaaacacacacattcagtctatagcaattaatgatagaataaaagacacagaaaagcatttgggtgataaaattcaacacccttccatgatgggagaaaaagccctactcaatatactaggaatagaaaggaacatcctcaacctgataaagggcatctattaaaaatcacagttggccgggtgcagtggttcacacctgtaatcccagcactttgggaggccgaggcgggtggatcacgaggtcaggagatcgagaccatactggctaatatggtgaaaccccgtc

SEQ ID NO: 40334 - DNA, 473 bp, Homo sapiens
ccccgaaaataggaaatgccctgtctaaccatctcacataacctcaacattcagtttcttcaggcttatgagaaagttcacttagtccttcattcattctacaatactactgagcacctgcaccatgccagataatacactaggaacgagggaagcaccaagtggggaacaaacccagtgggacaaaccagatgtactgatggcctggtggaggtcatcaaaaaaaaaaaaaaagttgaaattactcacagatcccatctgtgtctcaaacctttcacagggtgtgtttagcaatgctgtccactgagcacttttgcagatgggagactgaaggtgtaaaaggaagtgacttagacagctctgctcaccaggaaaaccaagagactggatttaaggacttctgatttataggcaaggatttttttaaattaaatgtatattcttcactcaaaatggctatttttgtaaatgct

SEQ ID NO: 40335 - DNA, 248 bp, Homo sapiens
actgtacctggatcgagatcctcctattttaagatgtgtggtggtactcttctggaagaaaatcctaaatataataatagagatttatacattagtaactcttattaagtaatttgtagcattacaaaagaattagtggttttataaaaggtttcaaattttctgtaaacattgaagtctcaatacatattaagttatttgatttggctgcgtattttccagaccatttctaaggcatactttgactc

SEQ ID NO: 40336 - DNA, 511 bp, Homo sapiens
tgctcaccaaagatttgcagaaaaaattctgatctgtcggagttacttagcctaagtgacacccatgtcctctgctactgtcctgccctgaatgaagaagggcagaccctggaaccagtaggtatcacttcctttagggctgtggaacagctacgcttagcctagctctacacatttgagcttttcagctcaagttcaacttgacaatacttgttgtaccccagaaaaggcaacaggcaacagagcctggtgatccctgaccagatagtttaaatcaccactctcagtgatcttgcctagggatctcttccttgagctccaacgtgggggcagcaggaacacgagggttcaggcctggggattctacacgcacctctagcccagcaaatggtggatatgatggggcccagaggagtgcagagccctgggagttcagggcggagagtgggaggagcgaatgttggtgaagagggagtaaacagcctgacaccagggcactggggcaggaaag

SEQ ID NO: 40337 - DNA, 273 bp, Homo sapiens
atagacgaggtctcactatgttgcccagactggtctcgaactcctgggctcaagagatccactcgctttggcctctcaaagtgttgggattacaggcatgagccactgtgcctaaaaatgtctggctacacagatcatcttttggcactctggtgcacttgttagaaacgatgctgtctcattccttttttttttttttttttttgagacggagtcttgctctattgcccagactggagtgcagtggcgtgatctcggctcactgcaacctcc

SEQ ID NO: 40338 - DNA, 3627 bp, Homo sapiens
  misc_feature (2529)..(2529): n is a, c, g, or t
  misc_feature (2684)..(2684): n is a, c, g, or t
  misc_feature (2748)..(2748): n is a, c, g, or t
  misc_feature (2982)..(2982): n is a, c, g, or t
  misc_feature (3515)..(3517): n is a, c, g, or t
cagggtctcactatgttacccaggctggtcttgaactcctgtgctcaagtgattatcttgccttggccttccaaagtcttgggatttcaggcatgagccaccatgcctgggcacaagaagcttttatggactgcaatttcaaaaaaaaatatgttcccacattagtctgtgaaacatctttcataacactaattacaccaacttgaaattctcatttccactttgatttgcttgtttctattactcattagatcaaatggaataacttacaattcttagcacaatgcccagaacaaacttgtttcaacaaatgtaatagtccttctcttttattccccatatccccaacagttcttaatatcaactttagattttatctatagaatagtttattgctagaaagattaatgagttgaaaatgtttcattttataattgaatttatgtaggaaaacagtagcaggcaaaattatactatttttgagtcttttaattcaaaagatgagtagtacaatgcaaaatgccttgatttggtgtttatatattttctttcccatattttaaaaaatgctccaattcttagatctctcaaaaccttgcattacaaaagccaaatttaacccatttgtgattgtaatataatgttcaactgttgtattatctatacaactccaaagaatggattgacctcaccccctgtgctcctgcctacaaattgccatttacttttatttgggacatttgtatatagttttatctatgtttcattatatcattagcagtttatacctttagagtctaaaatctttgactcaagagtctatggaaaaatggagaaagatttatatattagattattatcaactaactcttcatagttggctgaagccttaataacaataggttagtcagcatttgaataataattctggaaaagattaggaaaacataaattgtgtttacacgattgtgctcatgcactagctagtaccgaagagctgtagtgaaaatcttttaaatgtaaattggctcagctacctgcacatgtgtgaccagtttgaaatcagtgaaatgcagtataatgagatcatccttggaattcccgtcccccacgttgaaggctggtcacaatgctctgggtctatgggcattggatctcacagaaacattgatgaaatcatttttgcttatgatgcttcattaaaaaaatggcctctttagaaaacttagacccagtttgagtgcctgaactctgtttatccttagggtaacagttttacctctgaccattcaggtagatcaggttgtcaactgcaaatactcttttcccaaagtataaagagtacatcctcatatttatctgtactcacaagaggagaaaaatttcttaagaattatatttaaacagatattctcacctgccataaacaaacaggtttaagtatgtcatattattgcaaaaagcctttttttttaatggaaaagatagagacagtcaaaaaaaataaagctaatcaagcgggcccccattttgggtggtagcccagaacagcagaggaagcaggtttagaaacacagcaggcagagacacagataatcatcatcagaacaggcaagtgcagatttaccctgaagctaatgatgcttaaactatggagccctcctatctaactgctgagagcgcagggagtttctggaaattgtggaaggttctaggtaaatagggtaaacaacattggaagcaactctgataaataaccttgaaatatcttggatgaaattaatctctatctccaaagctctagtaattgttgattctaaatacttactttggaacctcattatgagtttgtagttatatatttttttcttagaaaacctctacctcaaattatatcagtttcaggcctcacagaatgtggacccttccttaccaaacagaaaaggctaaaggagtttcattccatttccttttagttcccattactgatattttcacttgtagcttggaggtcacggtctgtgttttgggagctaccgttagatatatggtctttcttcactaatttattggtatttctgttcaagaatcaatagtaagataaaaataatctgtaaacttacttgaaatagtggaatttaatttgactggggggatcagtcctaacaatgtcattttagaaaaacataattatcttcacattttattcatataatagatgagatgtgaaatgagcttcatggatgataaacgcactgatagctgctaagttttacactgtataaacaagaattgagctgcttctatagaaaaccataaaattttagtttagatgctagatatggagacaataaaaatactctaaatgaaagaaggttattaatcctataatgagatcagagtatcatatgcatttatgtacctgtaaatagaagaagaaatgagtttgtctccacacacaattagaggtatatgccaaacttatattttaaatattaaagtcaattatcctttgggaaaaatcacttntaaaggttatcataattataaatagttttatttttgtgacatggaaataattacattttctaagtcatgaaaaataccaaatagagaatactgaacttcaatagaagatacagaggcaaacatcagttgtgattttgcacatttaaaaaagaaanaaaaagaaatgtgtttatttgaaaatagttctaaacaagaaaagatcagaaccccacaaattcnaaagcattgtattagtcattagcttcagtggaaatataaacttgaactctgcaaagacagcaacaagagactgtagaacatatttagatgtagaatacattagaaaagtgacttggtcaggctcggtggctcacgcctgcaatcccagcactttgggaggctgaggcaagtggatcacttgaggccaggagttcgagaccagcctggccaacgtggtgaaaccccgtttctacnaaaaatacaaaaattagccgggcatggtggtgggcacctgtaattccagctacttgggaggctgaggcaggagaatcacttgaaccaggggggtcggaggttgcagtgaggcaagattgtgccactgcactccagcctgggaaacagagtgagactccgtctcaaaaaaaaaaaaaaaaaaaaaaagaaaagaaaagaaaagtgacttattttgcccatttaagaaaaatgcagattagcatttatcttccttgatctcatatgaccacatgctcctcatatgttatgaaattccaggagataaaagcaaaatgcgaatatcacttcaatgttttcattgtggtagatgggtatgcctaacgtggtgttaaagagttctcagtagtgttgtagatgatctccaagcccctgtctatcactgggataaagactacctcaataataaattttaaaatgcattaacttgaatgtatgatatactattttcatattgcctaaaggatttgacttctgctgtcaattctaattaaaannnaaaaagcgggcaagatgcagatactggttttgataagccacaagatgaaagctataatcctctcatcctcattcagctatccaattaataactggattacagtttctctg

SEQ ID NO: 40339 - DNA, 398 bp, Homo sapiens
cagaacagaggaaaagacctaggcctgggaatccaggcacctctggtcttgcctctgagctcattagctatgcaaccttcattcaaatgaacaaagaggtcctgaagctgataacgttgcagaaggtataatacaaaataaagagcctctcaagctcatttacattgtgataaatctatctccgctgtacagaagcaattacaaatcagacagagaccaaggtgctcttgttgaaggggatgagagacccaagccccacatattgtctctcccagcctaccacctcccctgtccctacctgcgcagccactcctgatgcaggttacaaacccagtgtgtaaactctaggatgaatgattgctaccattttttcaagctcaacaactatgactccatca

SEQ ID NO: 40340 - DNA, 328 bp, Homo sapiens
gcaagacccccatagaggctccttctttaagagccctgggtttctcccgcctccaacctgtccacttgtgtttcccctcaggctgctggtcattccggtcaggggagcagtgctccctcaacaggtcctccatcaggaaagagggccagccaagctggagcttggaaagcccagacacagaagctgccacacccaggcccctgggcctcctactgttcacaggctcagcagggagctcagagtgacagcgaagagctcagagagaagggtgtgcctaagctttggactagcaaagctggaggggactctagagagcaagtccaacccc

SEQ ID NO: 40341 - DNA, 315 bp, Homo sapiens
ctcttcccactccggggactcagcccaggacacctcgctgattcctgcccccttcacacctgcaagcagggatgccggcatcagaagaatgtttcgtgtacgaaattgtttggggggtttgggtttatttttgttggttttttctttttttttttgcttacgtgggcatccttcagcttttaataatctgaaaaattgtatttacccattgtcaatgtgtataaattaatctcagtcaattttatacaataaaaggtgaacttttatccatcaaacaataatttaacaaaaaatgtaccggaagaagaaaatgat

SEQ ID NO: 40342 - DNA, 908 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaacccgctgcagggctcccatggggctgagtggggagcagttttccc

SEQ ID NO: 40343 - DNA, 739 bp, Homo sapiens
ggaaggggaggatgccatcttttctcgcccgtctttcccccagggctggcaggccagctgagggatgggggtgagcagagaacagatgggctgtgggctgcttctcctggaaaaacagtagtatctgcaggatagggtacagtcttgggacgttagagctgagacaaccactgtgccactatctgcactccatggtcttaccccagatcggagtagcactgtggtgatgtgctagaggtctcaacaccgacatctcagaaaattttgtctgctgacagagcttggggagcagagagctcaccctttttcagttttagagaattaatccctctctctctctcttcattgttccggggcagttgctggctgggaacctttctgagagcccctgaatcaggcctgggctctagctgggttggtgatgcatgagcagggcgggggctcagtggggaaggactttttggggagcaggctggtggggcttagaggtttccgggttggatcaggccttcagtcccctctagagggaccggaagattcagggaaggtacttccccttccctttcagccctttctgaagaaagtgtgagggtttcttctgccccctggtggagacggggtgagctgctgctggtatgtgagctgaggaccaaccagcatctctcatctctgctgtgccctgcctgctgctgccctgccggttatgaggtggctgcagtccgggcactgctcctcttgg

SEQ ID NO: 40344 - DNA, 566 bp, Homo sapiens
cggctggacgagatgccgccgtcgcgcgcgcgcgcgcagctgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggtgggtactcgtcatgttcctgaggccagcacagagcgttgggtggagactggctgaggcaggggtctgccagtgagattgaggttggtcagcttctgatttgtgaattcatgtactttaacagctttatcagtgtaccatatagatacttagtt

SEQ ID NO: 40345 - DNA, 3341 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40346 - DNA, 3807 bp, Homo sapiens
tcagacttacagctactcaggaggctgactataattagtctgctgtacagcagcacatggcacaggctgtacaatgtgggtggggcttgtgtttggtggtggctttctgtctggggagtttagcgcctagtattttctcttactgcctcactccagcacactaggcccaagccccgggggctggccatttcagagacgctgccttcacggctgccagaaaagctccctctggccctgctggtagaaactggggatctggggttctagggaaaatgagaaaagggagagcctggccttggaggcctggtcacttgagcctcttcttcctcgtcaccccatgtctgtgaggaatggggctgtaggcagccgtccattcatccagacctctgtgagcctctgtgataagccaggccctgtgctggatatggagttaggaagagatggggcgaaattgtccttacccagtaagagcacagagccttagacatgcgacagtgtgatagcgtgggatcagggctcactacaggaaggggcttgaggaagaacgcagccaggtcctctacccgccgagtgcttctgccatgtggttgatgggcacactgtcatgctggcccgtgcagaccagacaagaaccacatgcggaggttggatgtggttgttgtgggtggcacttggctttccttgtggattttctcatctccacactctgcttcttccctcttttgatgattatagctctcctctgcaccctccaggctgtgaacacccgttccccgtagcagctgtgtggtggtgatggccccttaaagtctgggcattagcaggaccctgagggttggggtgctttggtggaatggctccttcaaagggctggggggccttgccatgcctctgccactccgaggcccatgaggttgtgtgagtcatgtcgcagagtggccatgtgttgccctgtgccctgttgctgccctctgcaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40347 - DNA, 4182 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40348 - DNA, 3922 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40349 - DNA, 1490 bp, Homo sapiens
tgcaggagaggctgcgtgtaaatcggacgaggggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40350 - DNA, 4131 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40351 - DNA, 2450 bp, Homo sapiens
gtgcttggaatagggcatggcacatggtgacctcccagggccttaagcagtgacagtggggagtgatatactcctatcctttctcgcccttctcaatgaagccagtttctctgattagcttgtcaatattgagcctttggggtatcttggttgcatttttagttacagagtgcgcttgcagaaccctctcttctccttggccgctggcagctgttctctgctctccctgcctctgtcgtgcttggcctcctcagcaagcctgttggctgtgggcgtccccagtactccgtctgcatgcacactccttggggagtctcagccacctgggttctggccccacctccaagctggtgaacctgggtctccacccagtggccaggtgccttctgccggacgcctttgcctgcctgtcccacactggctcctcctccaaggctccttgactgttggtggcagcaccatctgacctagagctggagtctttttccttggggagggggcgtcccttgcccttagtgatgttgatttctgccagtgggctgctgccgtcattcctgtcaccacaggttctgcatgggctttggctgacatcctcccctccagcctggccaatttcaccaggcccctccatgcttcttggaaattctcctttgctgcttgttttagctttaaggaaagccccgatgtctcaacctgaccatcagggttcctggtgactgtggtctctccttgtccacccacttccaatcataaaactggcttccccagctctggtgcaggcccttcaaattcatgggcagaggttgtaggcagacatgcattgcctttccctgcagtaagattttgaaccccatctgctttgaggctttggggttactgggccaatatacccatccctgcctgtcagactgtacctaggaattttggagagcaaagaaaatccttgtttctttatggaaaaaggaattgatgtgagctgtgcttgggttgaagctgcttttatgtggagaatgcaggcttccgcaacacccaacatagcccaccctgcatcctgtttcccctcagcagccctcccttcagctccaggctacatggagccctctgcttgtttttaatttacaaacttacgtgatattcaccaggtaccaccttacacgttagctcacttgattctcatgaccaccctgtgaggtgggtactcttatccccattttacggatgaagaaactgaggcacaaggtggttaatatttggagttgccctctggctccagcatctgttctggcaccatgtgctttcctcttggccatgtccctcctgtgccttcttgaactggcccttaactctcatgtccacatgctcagccccagggctggggctctaagggagaggcccctggcagctgttcttctcttccaggattgtggctgcacggctcaacggttcccttgatttcttctccttggagacccacactgccctcagccccctgcagtttagaggtcggagggcctggggtgggcaggtgttcacacttggtgggacgggcaggggccgtctacccattgctttctcagagattcttcacttggccttttgtcctcagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40352 - DNA, 887 bp, Homo sapiens
gcggccgcctactactactactaaattcgcggccgcgtctatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40353 - DNA, 1205 bp, Homo sapiens
tcagacttacagctactcaggaggctgactataattagtctgctgtacagcagcacatggcacaggctgtacaatgtgggtggggcttgtgtttggtggtggctttctgtctggggagtttagcgcctagtattttctcttactgcctcactccagcacactaggcccaagccccgggggctggccatttcagagacgctgccttcacggctgccagaaaagctccctctggccctgctggtagaaactggggatctggggttctagggaaaatgagaaaagggagagcctggccttggaggcctggtcacttgagcctcttcttcctcgtcaccccatgtctgtgaggaatggggctgtaggcagccgtccattcatccagacctctgtgagcctctgtgataagccaggccctgtgctggatatggagttaggaagagatggggcgaaattgtccttacccagtaagagcacagagccttagacatgcgacagtgtgatagcgtgggatcagggctcactacaggaaggggcttgaggaagaacgcagccaggtcctctacccgccgagtgcttctgccatgtggttgatgggcacactgtcatgctggcccgtgcagaccagacaagaaccacatgcggaggttggatgtggttgttgtgggtggcacttggctttccttgtggattttctcatctccacactctgcttcttccctcttttgatgattatagctctcctctgcaccctccaggctgtgaacacccgttccccgtagcagctgtgtggtggtgatggccccttaaagtctgggcattagcaggaccctgagggttggggtgctttggtggaatggctccttcaaagggctggggggccttgccatgcctctgccactccgaggcccatgaggttgtgtgagtcatgtcgcagagtggccatgtgttgccctgtgccctgttgctgccctctgcaggcctaagcagcgagagctggtccatcatgaagaacatggccacggagctgggcatcatcctcatcggctacttcaccctagtgcccgccatccagaggtaaggccccaaggcctgccacctggatgagcatggaagcaactgctgtgctccccagctgtgcagccatgggcagggtgctcccctcttcagcacaggcatccttgcttctgaggtgggacctctttgcc

SEQ ID NO: 40354 - DNA, 353 bp, Homo sapiens
ccctggtggagacggggtgagctgctgctggtatgtgagctgaggaccaaccagcatctctcatctctgctgtgccctgcctgctgctgccctgccggttatgaggtggctgcagtccgggcactgctcctcttgggctgggacagtgaggtcacggcacccccccatccccatgtgctctgattccaggagttctgtctctttgctgtcgtggggctggtgtctgacttcttccttcagatgctgtttttcaccactgtcctgtccattgacattcgccggatggaggtaggagtgggctgagccctgccctgcccgcctcctcagccctggctgtactgagggagtcctgg

SEQ ID NO: 40355 - DNA, 4239 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40356 - DNA, 3754 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40357 - DNA, 3127 bp, Homo sapiens
gtgtgtgtgtgtgtgtgtgtgtgtgtattttgggattgaggtcactagaccttgcatataggcattctgaaaccattccccagccacataactatcgcctccctccagcagccctagtgtgcagagccaagtactctttgttaactggcttttctcccttcttaccaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40358 - DNA, 4100 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaagactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40359 - DNA, 3483 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccacatatcatcatctgtcaggcactttggga

SEQ ID NO: 40360 - DNA, 4380 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccacccgacgaacattacaagcaacaaaaaaacgaacttttggcggacctcgaccctggagaacttttaaaacacattgttgggggcggcccccgaggacattagcaaggcgcacgtggcccacaggagaccttgcaagacaag

SEQ ID NO: 40361 - DNA, 2115 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccagcgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacca

SEQ ID NO: 40362 - DNA, 3743 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtggggcagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacatctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaaacccatcacagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgagcacacaggtggggatgagcacacaggtggggatgagcacacaggtggggatgagcacacaggtggggat

SEQ ID NO: 40363 - DNA, 587 bp, Homo sapiens
gtgagaggtgaaggggcgggcacccggcggccaggagagagagggagggcgccacgcaccggactgcgggccgagagcgcgcacgccgcggctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcaccaagacctgcagaagcaggaggta

SEQ ID NO: 40364 - DNA, 172 bp, Homo sapiens
tagactacttttcacttccagagcatgttttatgtccatctgagatatatagaaatgggagagaggtgtagggcaagtgaaatagttaccattttacagatgactgactgcagaacaagcgttagcaccagcgtcttccacatttgaccagagtgaccacggttgcactaca

SEQ ID NO: 40365 - DNA, 393 bp, Homo sapiens
atcttactgctcctctatctctctctcctccctcccataggaatgtcagctctatgagcgcgggcttcctgcctgtgtgttcagtgtcggatcctaaacaaggcctgacccctccacaggcacacacataatttttaaatgactgaataaatctaaaaatcatcactttattttcctctttgtataaaatctttgtgagggatggaaactccctccagcctcacaacgggagacatttaatgctgtaaaggctatacgatcgttagcaacgaatcattcctttacataacattcacacagcttcctacaatagacgtatttatgttgttgtctaacatacatgttttaattttcaagcgtttggttctggatccacacgttctctccaggagg

SEQ ID NO: 40366 - DNA, 337 bp, Homo sapiens
tactatacttcacttctacaaacctagatgaaacatgaaaacgaagccacacagtataaattgcaacttcaggaaaagctcctgctttattattccacataatttttcccatgtaaaatcaacgtccaatagttcctggtatgtgggaagataatatttgttaaagtcacaatgaagccttattgatggaagcttggatatataaacagcacaagttaggccgggcgcggtggctcacgcctgtaatcccagcactttgggaggccgaggcgggcggatcacgaggtcaggagatcaagaccatcctggctaacacggtgaaaccccatgtctacta

SEQ ID NO: 40367 - DNA, 1655 bp, Homo sapiens
tgttagcgtgcacagttctgcatacttgcttcccctcacctgccaggaacaggttagtgttccccattctgcacactttcttcctctcacctgccgggatcatgttagcgtacaccattctgcacactttcttcctctgtgtacgtgtgtgtggttttcctttcagaaatgggtcatactctgtggacatctttttccacttaaagtgatggcacagccattttcccagtcaagtaacatgaatgtacaagtttagcaaacttcctcctgagagatggagagatcaaggcttctgctccgtggcagccatccgtgcacatgcatcactgtgcgtgagttggtcccagtggcttgctgagacatgctctgcacaggggagatttcttataccagcagtgtgggaggcagtggggcaggtagagccacaagtggggatgagggagcagagtctagggcaggctcctggatggacaccagctacactgtctattggatgtgggacttccctcactgatgaaatgaataagagaatcttcctcatcctgctgttgttggcgttaaaacgggttaatgcatgaaagcaacaaagcccggcctgcagacagcacttggtaagtctcctcttcccagcatgttcaacaggaagccctcattccctctagaatgtaggagtcttgccagcagtggcctgtttgttctctgcctgttgccgacctgatgagaacataaaattggtgtcttctgtatagatttccttcttattgcccctactgtggctgaacataccttcccccgtgcttgaagtctgttcatatatgttctgctgtgataactgcccattcttgttctctatctaagaaggcatttagttttgaaaatattttgttggcttgtaagatatttgtacatattaagcacagcaaacctgtaacatattcactgtaaatcattattcctcatgcatcatttgccatttaactgtatttttttcctttttgatgtaacctgctatagtttacatttttaaatcagaaatgcctgcacattttaaaacgaagactcttatgctctagcctttgaggtcatgcttggaaagtcctttctcacacaaagattatttacactttcatctctttttctctgagtacgtttcagtgtttaattgaccaggaatgtatttcgaggtgtgatatgagacaaggatctgaaatgcttcgcccactgaatcatcatgcactgaccgaaatgccacctgtatgagtgctaaaatcattgtcgctggacctgtgtctgcactgtttaattttagtgttgtttctcacatcagcttctgttgttttcatggttgtggttctcatacttttaatatctgttggagcaaataaagcctcgtttctcatcttttccaaaaatgtcttatgtatgtgaactttggtgttatttgtcaagtctgggcattctcccacccccatattaaagaatgctctctggagtttgtctggaggttttgtttaacttttagattcacatcaggagaatctttgtcttcatggtaagtggtcttcccatctaagactatttcttcaagctgtttgtaataaaaagctgtgtgatttttgtatgtttattttggtcaccttattgaaaccttattt

SEQ ID NO: 40368 - DNA, 342 bp, Homo sapiens
cctttacaatcttcccagcatgtttcagcagttccaccatgtttctcagggcctaggatgttttatactagtctgtcattcttggtgtgagtgccttttatggtcaggctttctgcttcagtgtcacaagaccactgttaatattccagatatctcattctttctctacaatatccaaagctggaagagtgaaaaggagcaagacaaagctctttctccaatgctatgtctttcattaggaaattaaaaatttcccggaaacaaaccatgggagttaccctggcatatctaattcgtgagaagtaggtcatactggtcctcttagaccaaaaactggcaaaa

SEQ ID NO: 40369 - DNA, 557 bp, Homo sapiens
tgaaaattgcaagactagatatttcctaagggcctttcctctgattttgggaaaagtatctcacaaaataaaacatttttctggataaaaatatcagtttattagaaagcaggtttttttttttttttttttttttaagaaacttagaatgtttggtatatttggtcatcccacttaagctgttggctccttcattcattcattcattcattcattcattcagtgattcaatgtttatgacactgctttgtgccagacataggagctttgcactgagggtcaaagggtgacaagggcagcctgttgtttcaactggtgacctgcttagcctagtttccctttgagtttggcttatcatgttactgatgcagaaaaacattttatgtatttttcagtagaccaatagtgataatattgttttaatgaagaaagcttttaggtttctggagagagggaagaaaaataatgtgtaaaaaataggcatccatctgatgtgatacctttgaaataagaatatttggaaggtctttactgagtttctcatggaattctggtgg

SEQ ID NO: 40370 - DNA, 386 bp, Homo sapiens
cgcagcaggcttccggcagtccaaagggctttgagagctgcagttggcagaaacagagggcacggtccgcggactgaggggcaggggtgagtgcccgcttggtctgggccactcccggaggccgccgcgtgggaaaggacttgggtcattggtaaaagtctagtcccaggatacaatgagctgaagtggtaaccagtgcacagtggacctgctttgcagcttgggcatgccacgcaaatgaacaggacttatcatttgttcccttgattgctctgagactgagtaaagttactcagtttcctgatgccaaggttgcaactgaaatatcctgtaggagcgaaagaggtccgtcatgctttccacagcacatcaggcaatccatccaa

SEQ ID NO: 40371 - DNA, 324 bp, Homo sapiens
attggatgttaaattgttcaggagtacctaattggccgttaaaaagtaaaattcctatcctgcaatttaacactaatatcaaaatggtttaaagatttaaatgcttaaaaatgaaatagtatcagaggaaagtacaggttgcgttgaaataaatgcatagataatatttaaataatattgaggtgaggaaggaattttccctagcgtaaaactactgagagttcattaagattttattgtggagattcaaaaagaaaggtttattatactaaacgggaaaatgaataaactaagggggaatatttgaaatatgaccatagtaca

SEQ ID NO: 40372 - DNA, 371 bp, Homo sapiens
gctcgactttttttttttgagacagagtcttgctctgttacccaggctagaatacggtggcacgatttcagctcactacaacctccgcctcctgggttcaagagattctcctgtctcagcctccccagtagctgggatcataggtatgtgccaccacgcccagctaatttttgtatttttttagtagagacagggtttcgccatgttggtcaggctggtcttgaactcctgacctcaaggtgatctgcccacctcggcctcccaaagtgctgggattacaggagtgagccactgtgcccggcctttttataatttctaactctttgctgagattttctattttctccaaggtttcaagaaagtttgtcgat

SEQ ID NO: 40373 - DNA, 409 bp, Homo sapiens
gacaaaattctatacctcatagaaactgctatagaatacgtagaaactgggaaaaatttccatctgacataagacttgagctctaaatggttcctgtcctttaaaacaaagtgacaaaatagaaataaaataaaagttaggtatcagcatgtgaaaaagaatccctaggccggcaatacccaatatagtagctactagccacaggtggctactattaataagtacttgaaatgtagctaatcccaaatgagatgtgctagaagtgtaaaacccatgctggacttcaaagacttaatgcaaaagaaggagaaaaaaagtaaaatatctcattaatatttttaataatgattacctgatggaatgatgatattttgggtatattgagttaaataaaatatattactgaatt

SEQ ID NO: 40374 - DNA, 1657 bp, Homo sapiens
tttttttttggcaggaatgaaggaaagcagatgaggtgtgtcccgtccctgacacctgcgtccactctgtcccttctcggcagcccccaggcaggggcagatgggctctgtcttcggggggctgcaggggcctgctttcctcacgagttccacctgcagaggcccaggcattatccacgctgcgggaagaggcagtagccacaagcagaacacagcccccctcctggagcccatggcccaggtggtaaggggtggccggtgtggggggtcccctggagcagctgggcccagtccctgtgagcgctgctgtcagcctgaaggtggtgaggggagggagccccgggagtacctggaagacgcgtgccccaggcatgaggccccctcggggccccaccggccccatgcccaggtgccccaggtgccagtgtgactgggcagtctcccttggctgccccgtgttcactcagctggtggagcagatgagtctctgagcatcttggggttggcagcggtcgcaacttgtgatcacagaacacagattccgagaagcacttgagattctgttcaggttttcaaagacgcgtgtgtgcgtgccctggcggcgcagcagatcccacttctgaccgaggcagggtgtgtgtttacacagatgagcctgggcagagggagcccagaggccctggcatggcgcccccctccttccagcacacggagaaggcctccatccctcatatgccacgctgtgacacggtttgggactggcagaagatttagggcccagtgcacaggctcctgggcaggcgggaaaccatctcccgaaagcagaaaacgttggccacacggtggcagcagtccctcaggcgtcctggtcgtttctggttgtcgcaagtggactcctcttcctttgggaggctggatctgtcttcctcctctcactgtgagcagagggagggagagctagcagagcctgagctagggccgggatctaatgaccgccctctgcctgtccttgggccctgaaaccaggggctcttcacacacatgcagctgtgatttcagagccggtctcacttcctattggcggtgccgggccaggacagagttggacagagctgtggaaaatgggtctccaatactatcttgttttgattccagcgttccatcagctgccttcatgacacttgtacagccgcattctgagctcaaccctgaccttgcagctctgtttttcctttttggttacctatctgtttttcaagaacaacattgtggatataaataaaatgctaagggaaatgaaagtggcaagaaggtgtttttttaaaaaacaaaaaaaaaccatcatcaacttttccccatctgagcagagcagggaggcccttttgtaagtccctgaattgaagcaccttacctctgcgtggctttgctgaggagagtcacagcccacagcctgattctagaagtttcctttgggaggctcttcgggcctgcactcttagttgaggccccaccctcacctgaagagatttttctagacagtatcaagcctatgtgacataagctcactttaaaaacagattccccaaagtatgtttccagggagcatttgagaataaaaacaagagtccaacttatttcaccctcttctgccctgaaa

SEQ ID NO: 40375 - DNA, 393 bp, Homo sapiens
tagatagctgtatttctcttgcaggaattaaaggccaggagcagaagggagttccccgtaaatcagacctgtggctggcttatcttttatccattacgtactgtagagaagaaactcccgagagaggctgagggcacacgaaacatttcctgcctgttaaaaaaaaaaaaaagaaaagaaagcattaacttcactgaggatatctcttctgaacaaaccattaaattaaaaaaaaaaaaaagataaaatattcttaccataagtagataataaggctcactgaaaggaacagcagaccagaaatgcagaggatctgtggcctcactgcaaatcaggtctcaccagtctcctcatttactaatgacttatgaccacccttaccgggcaaggtag

SEQ ID NO: 40376 - DNA, 513 bp, Homo sapiens
gtcctaccatatacaaagcagatcactgagtcagctccatgactagttacataggaagccctggattggcgtgaaatactggtgcccgaggttcctcctgccccttaggctcactgacagatcatcccaagcaggcttatcaggttgggtctaattttaaaacagtcattgaggagtcctggccaccccacccctgcttttgtttgatgcttcacctgtgtttgctgggttatggtgtaacacagtaaatcctgtgtgtattttaaacaccaaaaataatgggatctgttgctggtctcttttacgaatttcaggtttcactgtgagacagaattcatttcacctcagtcccatgagcacttttgtgtgttctaatttctctacgacaccataatgggagaagacaccgatgcaacctgcggaggcctttctgcagacccacctttaactggttttctctctcccaacttgggctggccaggcactagcaagaccacactctgcataggaaga

SEQ ID NO: 40377 - DNA, 361 bp, Homo sapiens
  misc_feature (31)..(31): n is a, c, g, or t
ccgcatacttcgatagcatttttatacgagntaaggcccaggccaatcggccgagctcgaattcgcaggctgccccagtcctcctgccaggccctgggcgcccacgcccgccacgggctttcagccgcgggctgctcctgctcctcgccccgggtgagcctttgatagcgcgcggccctcctcccctctgggacgtcagactgtgttgtccctgggctggttctactcggctttggtgtttggggttaggtctcctagaggaggaggcggtgctatcagccagggtttggcttcaggtcactgggctggtgatgctgaccgtagccctcaaggacgcccttcttgcccaccccgaggcgtg

SEQ ID NO: 40378 - DNA, 640 bp, Homo sapiens
  misc_feature (31)..(31): n is a, c, g, or t
ccgcatacttcgatagcatttttatacgagntaaggcccaggccaatcggccgagctcgaattcgcaggctgccccagtcctcctgccaggccctgggcgcccacgcccgccacgggctttcagccgcgggctgctcctgctcctcgccccggggctgtgactccctgacgcagatccagtgcggccagctgcagagccgcagggcccagattcaccagcagattgacaaggagctgcagatgcggacgggcgctgagaacctctacagagccaccagcaacaaccgggtgagagagacggtcgccctggagctgagctacgtcaactccaacctgcagctgctgaaggaggagctggaggagctcagcggtggcgtggaccctggccggcatgggagcgaagctgtcactgtccccatgatccccctgggcctgaaggagaccaaggagctggactggtctacaccgctgaaggagctgatctcagtgcactttggagaggacggcgcctcctacgaggcagaaatcagggagctggaggcctgcggcaggccatgcggacccccagccggaatgagtcgggcctggagctgctcacagcctattacaaccagctgtgcttcctggatgcgcgcttcct

SEQ ID NO: 40379 - DNA, 625 bp, Homo sapiens
aggagaagagttgctgcagctccttccctgctttggaggaggaggggaggcggggtaagtttggtgggaaactctgtaatttccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataaaaaagtggcctcgttggcctca

SEQ ID NO: 40380 - DNA, 561 bp, Homo sapiens
ctctatagctccagacagacagaagaaagggattcttttcagtctagaaaaatgctcaccccttcctcagaacatttccactgtgacgaaaagagactgatgaagcctcagagagaaaggcaactctgggtggtgatgcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctgtggaagaaggctgctatgactctttggatgggagtctggcaagaggaaattggaagataaaataaataataagtgaaataaaaaagtggcctcgttggcctca

SEQ ID NO: 40381 - DNA, 494 bp, Homo sapiens
gcctggccacgtttcaagtcatggcgaatgccagagggcaaagtgggtgggtcttacaacctggtagagtcaagaggcaaagttcagaggcagaacggatggcggttctctgatgtatggcagggcggtgggagagaagggaagagaaagccgtattataggaaaagaatttttaaattgggatgctaaataaccattgatcatagagagattcagcaggaggtgaaaggactgtggaggagaggggtacacacacatctttcccaggagctatcacagagcaatcccagctcagaatatctggggagtttccatagagtgtggggggcatgaaggggtttctcgggtctcctgactccttttattttctttctttctctgcttttttaggtggaagaaggctgctatgactctttggatgggagtctggcaagaggaaattggaagataaaataaataataagtgaaataaaaaagtggcctcgttggcctca

SEQ ID NO: 40382 - DNA, 228 bp, Homo sapiens
ggctccccttcctactaccttgtggttcggtgggtccgaatccattcagagtccagatctgaacgatgccgtgtccagtttgcgaagtcctattcccctcctcctgtcgtgtgcctttgttcaggtggaagaaggctgctatgactctttggatgggagtctggcaagaggaaattggaagataaaataaataataagtgaaataaaaaagtggcctcgttggcctca

SEQ ID NO: 40383 - DNA, 467 bp, Homo sapiens
taacagctgaagctgattaaaaccattaaagtatacagagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataaaaaagtggcctcgttggcctca

SEQ ID NO: 40384 - DNA, 601 bp, Homo sapiens
aggagaagagttgctgcagctccttccctgctttggaggaggaggggaggcggggtaagtttggtgggaaactctgtaatttccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggaagaaggctgctatgactctttggatgggagtctggcaagaggaaattggaagataaaataaataataagtgaaataaaaaagtggcctcgttggcctca

SEQ ID NO: 40385 - DNA, 663 bp, Homo sapiens
ctctatagctccagacagacagaagaaagggattcttttcagtctagaaaaatgctcaccccttcctcagaacatttccactgtgacgaaaagagactgatgaagcctcagagagaaaggcaactctgggtggtgatgcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataaaaaagtggcctcgttggcctca

SEQ ID NO: 40386 - DNA, 737 bp, Homo sapiens
ctctatagctccagacagacagaagaaagggattcttttcagtctagaaaaatgctcaccccttcctcagaacatttccactgtgacgaaaagagactgatgaagcctcagagagaaaggcaactctgggtggtgatgcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctgtgagttgattggggattgggggctggggggagacaggacatccctagtgacgtggaatacatagagggctggaataccaggctttggtggatgggagaaccaaataattagtacttcattgcaggtattcatctcaacttggccatgtttcactaagatttaatactaaccctgtttacagaacactgggaagatatggtacagttaaatttcagttcagtagtattcaataggtatgtaatctatgcctaaggctgctaaggtaactgatgctgataa

SEQ ID NO: 40387 - DNA, 834 bp, Homo sapiens
aggagaagagttgctgcagctccttccctgctttggaggaggaggggaggcggggtaagtttggtgggaaactctgtaatttccttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccagttatgatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtaagagtgcagccactggctttgggggagtctgtgaaataatattttttaacttcccacactaaaccgaagtaattcttaccagtatctctagttagtgtttccagcctggtcaattatcagccactgaaggaagagatttaggctcatccctataatcccagcactttgggatgatgacgtgggaggatcgcttgagcccaggagttccagaccaggctgagcaacatagtttaagtccaggctgagcaacagaccttgtctctacaaaaaaattaaaaataaataaataagaactcctctacaagacgtt

SEQ ID NO: 40388 - DNA, 488 bp, Homo sapiens
ttaaactttagagaaaaattgaagtgattgaaactggggagttttaaaccaacaaagggaaatttttgttgactaaatgttagctcgtgcctctgagtctgctgagtgagtacaagacacattcttgcagtgtgtctggtgaatatttgtacttgagtttcttatgatgctggtcttaaactggcaggccctcacctggcagtttacaggttaaaagtttaagtctggcttccagaatatgaaaacacagggagctcagctgagcacagcagagttgcagccctcatgtaacatgaacaggaaatacatattaacacagaaattgatcctagactgccggggtccatatcccgattctgcctgtctaacctcgaggaagttacttaccatctctgagcttcagtttatcatcagcaaaatgaagataaaaggaccttcatctctttaaggtacttagcattgtgcctgtcttagaacttagtatggta

SEQ ID NO: 40389 - DNA, 808 bp, Homo sapiens
gtgagaaccagtctctataaaaaaaaaaaaaattgataaaaatagctgggattacagacgtgcaccaccatgcccggctaattctgtatttttagtagagacggggtttctctatgtggtcaggctggtcttgaactcctgacctcaggcgatccgcccgcttcggcctcccaaagtgctgggattataggtgtgaaccactgcacctggccaggacctatttttattgtagactttactgaatatacataattctgagtgcagatatgaaagctagtactattcctgcaaaaaatgccaaagccaagatgcgatgagtgaaatttcactacagatttgttgatggaagggcctaagtttttcctcgttcactatcatgttttgcctagtgatggtcctgcttttgtatggcaaagtcacatatagcaagtattcttttctacactgttcgttgtgtaaggaattccctttgcaaagaccatgtatcccaattcttgcctagattatgagcaattttgaattagtgaaagttttattttcaaatagtaaatatagccagttgccctgcctcaccttattgctgatcatgcaaattatggtgaaaatcttagagcttaaaaaatatatatgggctcagttgtagaaaaaaaaagaaaggagctgttaaaaaaattattttagtccaggcatggtggctcatgcctgtaatcacagtgctttgggaggcggaggtgggaggattgcttgaggccaggagtttgagaccaaccagggcaacatagtgagaaccagtctctataaaaaaaaa

SEQ ID NO: 40390 - DNA, 767 bp, Homo sapiens
gcaccactgcactccggactgggcagcaagagcgaaactctgtctccaaaaaaaaaaagaaggagcgacatatttattaagattaatcttgatggccaggtgtggtggctcatgcctgtaatcccagcactttgggaggccaaggggggcagatcacttgaggccaagagttcaagaccagcctggccaatatggcaaaaccctgtctctactaaaaatacaaaaattagctgggtgtggtggtgcatgcctataatcccagctactcgggaggctgaggcagggggattccttgagcccaggaagtcaaagttgcagtgagccatcattgtaccactgcactccagcctgggtgacagaacagtaagactgtctcaaaaaaaacctgaaatgaagtttcatatctttatgaaagtaaaggaagatacttctgtctgaaggacatcagtgaatctaaattgccatttaagagagaactcgggctgggcgcggtggctcaggcctataatgtccagcactttgggaggccgaggtgggtgaatcatgaggtcaggagatagagaccatcctggctaacacggtgaaactccatctctactaaaaatacaaaaaaattagttgggtgtggtggcgcatgcctgtaatcccagctactcgggagactgaggcaggagaatcgcttgaacccaggaggtggaggttgcagtgagccgagatcgcgccattgcactccagcctgggcaacaagagcagaactccgtctcaaa

SEQ ID NO: 40391 - DNA, 317 bp, Homo sapiens
gttgaactgcttgcttgaactcaggaggcagaggctgcagtgagccaagattgtgccactgcactccagccctgggtgacacagtgagactgtctcaaacaaaacaaaacaccagcctgggcaagacccccatctctacaaaacattttaaaaaatcagctgagtgtggtgttatgcactggtagtcccagatactcagaaggccaaggcagggggattccttgagcccaggaagtcaaagttgcagtgagccatcattgtaccactgcactccagcctgggtgacagaacagtaagactgtctcaaaaaaaacctg

SEQ ID NO: 40392 - DNA, 360 bp, Homo sapiens
attaatatgatgtgcttattcaaaatctgatatatcagttaccaatatttttcaccttcaccgattttattcttatgtgattgttatgtttccttttggagtcaatggctgttgtgtgaggaggtcttgaaaaatattacaggaagaggacagtaccacaaaaacctacatgactatgcagaactaccgatcaattgtcccaaaacgagtgtcgaatattctttgtcttaaagttctgcatggaattcttacacatggaaaaataaatttgtggcaaaatgaaactcatcaaccaattgtcagctaatataaaatgttgagcagaatgcagtgatttgctgtttctgggaaggtaaacat

SEQ ID NO: 40393 - DNA, 231 bp, Homo sapiens
atggcaaatagaagttaagtggagctgttaatgaaaagggctcctctaagtgggagatggaaccagggttctgtcccaggcattctcactatcctggaaagtgattacaatcagccgttcatttatttcctcattccttctttcatcagatacagattggatgcccactgggtgctggtctttgttacagacgtctctgctttgtctaggagggctgttctgccacctggc

SEQ ID NO: 40394 - DNA, 389 bp, Homo sapiens
tagagaaattgttttcatgatatttcctatctccttttgtcactttgcttttgtcggtaaattttacaactaaataaggattaccaggcataaaaagcagcagacaatcatgatgcaaactgaaaataatcaatcaaaactgacccagaacttaaatagatgttaaaattagcagaggaggacattaaaactgtttttatacatgtatctcatataatcaaaacattaaatagagacatgggagataaacaagaaaagccaaaatcaaactttcaaagacaaaaacatttgagatgaaaattacattggatgaactaaggcagattagaaactgcagaagaaaagattagcaaacttgaagatacaagaacagacactagctaaagtac

SEQ ID NO: 40395 - DNA, 544 bp, Homo sapiens
gtgtggttgtgtcataaattatgtacctgttctctgttgaacatatagatttttttctgagtttttccttagcaaaatgctgcagtgagtacccttgtacatagatgtttgtacatttgttctagaaaaatctacagtaaagattcttagattaagagattcccaggttattagaaaatttctctattaatttagatatatacttccaaattgcctgaccaaaaagttatgtcaatttaacttctatgaacagtatacaaacatgacaattttccatcacctacaccaactctgggtaatttcatcttttttacaagttgatggattgttttaatttatatttctctggttattaataaggttggccacctcttcatgtgttattattgatgatatttgtattgaattgtttgaattttcttgatttggaaaacctttttacatgtcatagatattaaatatttgttgtaaaactctccttccagtattttgtatgtgtttggtcaagtagaataaactcttgtcctctgaaaaaaaaatcctt

SEQ ID NO: 40396 - DNA, 421 bp, Homo sapiens
gccctccccaggacagggtatgaactcctgtcccaccctcaaaacactatcagtcaaaaagattcatgccaggcactccagaaatgcatccggcagagagtgagagacgctcatttgcccaggtttgtgacaacactattttgctttttcctggctacttttccttccgatcacactggagctaaatccccagggaccattgtgtagggcgactcttggttgggaagaaagggaaaaggtgaaaaaagcagggcagcgtagggcaaagaggatgttttgaactggcctcactggaaatatacacattcttgacatttctgtttacttcctgtgaccaagactgtcaataaatacataaaagtgacaagttttacaagttgagacaatgggaaggaaagagaacttggatttactgagccat

SEQ ID NO: 40397 - DNA, 355 bp, Homo sapiens
aaatttcctctacattatcaaagctctttttattttgaataccgttttccaaatttcattttttctttgactcataaaatctagtgttttgaaaacttcttatatggagctttcttttgatttttaatatgaaataactactatgtatttgtttgagacctcctgtgtatctcgttctgtactagatgctatggtagactgaaaggaaatgtgacattttctaccggccctcaaagaattagtcatttaggtggggagaaaaggtagttgatatgatgatagaaaaccaattgtaagtattaagggatattcaatgacagttggatgtctttgatttttttccattcagtcctaa

SEQ ID NO: 40398 - DNA, 595 bp, Homo sapiens
tgtaatggaaaagtctagacatagggctggcttcaagcttagctggatccacgtgttaaaggactatcaggattatctttctgtctggctgtcaactcgtcttttctctctgttggcttcacccacaggcagcctctcctccatggagcgggctggccatgtggtcatcctgcaacccatcactgtgattttggttggccaggtctggaccataagtctagtctggagcctgtggctgggagtccatcctactaaattgtctggatggaggatgaacttcaggggaagggctgctgtaattttggatggggtggttaggaatgtgatgtggcagcagaggcttcctgaggcaggtggctcctaggttttcttcctgagcagtttgaatcctgcaaggggagtgaggactcttttccttgccctgactttttgctgtccgggagcccttcagagacctggcactagtgtttcctctgctcacccaggcagtaccccgcttcctccgaggagggaaacttgcccactccatctcatttttcttcgcttgcatctgtgtttcttggaatctgctctttcctcctacaacttaaaaaaa

SEQ ID NO: 40399 - DNA, 1030 bp, Homo sapiens
taatcacctgggtgcaggcaagctgagtccgaaaagagagtcagggaagggagatggggtggggccgttttataggatttgggtaggtagtggaaagttacaatcaaagggggttgttctctggctggcagaggtgggggtcacaaggtgctcagtgggggagtttttgagccaggatgagccaggagaaggaatttcacaaggtaatgtcatcagttaaggcagggaccagccaatttcacttcttttgtggtggaatgtcaactgataggcatttttatgggtaccgtgttgaatctaaatcacattgggttatataattatttaacaatattaatttttccaaactatcaatatgggttgtatctctatgtatgtttttaatcattttgatcaacatttatagatttcaaggtacaaacttctcagctttgtacgtttattcctaagtatttcttactttaagttctctagcaaatggaagtgtttttaaattttcttttaaaattgtttattgttaatgtgtggaaattcaagtaatttttggtgccgatattgtattgtgcaaatccactgaatttatttagtagttttgagggaagagagagaccctctcatattgttttatattgttttatactcagtacctgttttaggaaaaaaacaaggaagtgaaatcaaagacaggcagcccggcgccaggcctgaaaccaggcctgggcctgcctggcctaaacccagtagttaaaaatcaactcataacttagaaactgatgttattcatagattccagacattgtatagaagaacattgtgaaactccctgctctgttcttttccactctgaacaccggtgcatgcagcccctgtcacatacccactgcttgctcaaatcaatcacgaccgtttcatgtgaaatccttagtgttgtgagcccttaaaaaggacagaaattgtgcattaggggagctcagattttaaggcagtagcttgccgatgctcccagctgaataaagcccttccttctgca

SEQ ID NO: 40400 - DNA, 181 bp, Homo sapiens
gggaaaccaaaatatttgtgtgacttactttattgtgatagtcactttattgcaatggctggaattgaacagtatctctaaggtatgcctgtataggtgatggttcttgagatgtgaagtgcctggatgatgggtgatgtgaagtcatgggcctcaaggggttcatgacccttacagtctg

SEQ ID NO: 40401 - DNA, 439 bp, Homo sapiens
ccatctgtactatgggataaattcaattagctagatataaatgtcaaaattgataagaggtagaaaagatcacttattagatactaagtaaatgattattaaataatgaacaataggaattacagacttcagccgtaggaaagaaacattactggatgaactttttcagttcttggatatcaacatggttttggttattacagtgattatcagtaatatttaatgcatgaggctagggtattctggcattcaacgatgctctgtgcagtcctacccaattaagaactgctatgatcctacacaactttgaaagtctaactaaagctactacaaatataaattggtatgtcacttcttccagagtttatgtttatattcaatgcagtccctataaaaatcccagcataaatttttgttaaataaaaaaatgcaaaggacc

SEQ ID NO: 40402 - DNA, 2326 bp, Homo sapiens
aaaaaaaatactgcaagaacatctgccccagaactgcctgtccaacctggactgacatcatccttgttattgatctttgtagccaaatataattattttaaaacaaacaaaaaaagagaatgtaagcagtataagactttaaaacacacaaatgaaatatacatgactacatgcttcagtgaactaaaactttcatctgtaatctttattttgcaacattctgaagtaacattacagtcttttcagtgtgctgtgtcatttatatcccttactttatcctaggaatcctgtattgccattgagcatatgcagattgagacatgtgcatagcttctccccgttgagcccatcagtggggaggagctatgtaccggggacatttggcaaagattttcacgagtctcttggatgtaacagctccttaagaaaacctcagtttaccttccctattttttaccatttgtaaaactaaggctcagtgatgtaaaatataacacattctgtgctgtggcataactgcagcttaggtttttatattcaagacaagcagaggtatagctgaaaaggtatgaacacttactatgcttcaagatcccttcgttggtttagttgtggcattttagaacagctgacttgggactaaagcatctttctatctgggatcagtatttctaagttgcctttaagctgaataaacatttggtttttatatttagttgcttcgatgtgaaacactgcaatttaaaaaattacacatatgtaatatagtattttacactaaataatagtgactggcagtccattggccgaagaagtattatttttcagatattctgctctgtcatcagctatagacactgacaggtatttatctggaaaggcttgctgtcaggggttcacagtgctgcttgtgggttatctccagaccctttacatttggcactttaggacagcgtgagtcacaggttgcactagaagttgcctttgaaattagacctaaactatgtggaactggaacccttgtacacaaagctctctatcatccaaatcctgctgaactctcttaggaaagaacagttttacagattcattctttccacacacaagatttccccactgcccagttactctcacctttttattttcttgactgttatgttttacttgactctggaatcttaccttgtactctcacatttacatggaagtatagcttatttcaccaattatactatcaaaagcagaagtagttacttacacctgaaaatttgtactgagaatgtagctgtgaatatgtttaagaaagtatacttaaagcagaaatccaaggaagtatatttaaatcaaagcaagaaatcccatttccaaatggcaataaagcatgtgttacatagaatcagtgcatgaaagtgttttagtagcccagattagattgtaccctggcgaataagcaagagttctttttcattttcatcttgcaattcaactgggtatttgggttctttttctattcactcatgtcagatagagacatgcatgttgtaaattattttgtcagaatgaaagcctggcagattaaatgctttcttctcttcttgctttacttgatatcaatctcttgttcatttcttgataatatgtttggttatttttgttttcattgcttttagtgtcagagatggctttggattccccattctgtgtgctgctgtctggctcctgaacccacctgtagaggtgtgtcaatcccagctggtgaagtactgagaagaagctacacaaaaggcatcaaagtattagtaagtgtacctctgacattttaaccacctctgacttttccatggaatggacaagtagtagtctctgtcagagctacattttaaaggagaaaaagaaacgtgaagtcatgaactgtttatttatgctgttatttttgtgtttactcacctcatttatattgacttgtaaattagtaatttctgaactattacttatcaattcattgcctacatgtcagcaaacaaattttcttcttaataaagaatacagttgctgggcacaatggttcacacctgtaatctcagcacgtttggagggcaaggcaggaggattccttggggccaggagttcaagaccagcctgggcaatatagcaagatttcatctctacaaaaaaatgaaaacattggctgggcatagtggctcattcctatagttcaggctactgaggagcctgatgtaggaggatcacgtgaccccagtagtttgaggctgcagtgagctatgatcctaacactgctctccagcctgggtgacacaccaagttg

SEQ ID NO: 40403 - DNA, 1033 bp, Homo sapiens
  misc_feature (936)..(936): n is a, c, g, or t
  misc_feature (945)..(945): n is a, c, g, or t
  misc_feature (971)..(971): n is a, c, g, or t
  misc_feature (973)..(973): n is a, c, g, or t
  misc_feature (1025)..(1025): n is a, c, g, or t
agatgcacatcttctctgggaaaattcacctctagtctacacctatgaacctactgggttggtgacatttacaagacagagtcttgaagattttccagaatggaaaagatgtgaaaaacccttgacacgattgcatgtcacttacgaaggtaccatagaagaaaatggccgaggcatgctacaggtggattttgcaaatcattttgttggaggtggtgtaaccagtgcaggacttgtgcaagaagaaatccgctttttaatcaatcctgagttgattatttcacggctcttcactgaggtgctggatcacaatgaatgtctaattatcacagtgtcagagatggctttggattccccattctgtgtgctgctgtctggctcctgaacccacctgtagaggtgtgtcaatcccagctggtgaagtactgagaagaagctacacaaaaggcatcaaagtattagtatctactgtgcgtttcagtcaacaatacagcttgtgttcgacaatattccttgatgacagcacagccatccagcattatcttacaatgacaataatatctgtgaccttggagatacctcatcatatcacacaaagagatgcagatagatctttgagcatacctgatgaacagttacactcatttgcggtttccaccgtgcacattatgaagaaaagaaatggaggtgggagtttaaataactattcctcctccattccatcgactcccagcaccagccaggaggaccctcagttcagtgttcctcccactgccaacacacccacccccgtttgcaagcggtccatgcgctggtccaacctgtttacatctgagaaagggagtgacccagacaaagagaggaaagccccggagaatcatgctgacaccatcgggagcggcagagccatcccccattaaacagggcatgctcttnaaagcgaantgggaaatggctgaagacatggaaananaaatacgtcaccctgtgttccaatggcgtgctcacttattattcaagctttngtgattat

SEQ ID NO: 40404 - DNA, 373 bp, Homo sapiens
ctcaccggcatgctggagcaggagacagcctggcctgtaagtttcttgctagcaaggacctctctgccatccgctgcttggactgtctgcacagagctctggaggaattcaactctgggcgtcttggagaacttcagaaataagttaataaaaaggatacacagaggctccccagctggctcctctgcaccggtgagcatcgggaaagccatgagggctgagggctcagctgagtgcccgtggccgcagagtttttggatcctgcagagcgtgatctgttgggcatcaaactctgccagagtcaagggagcgggaggctgagggtcagggtggagtagctcagcccctgggcgggagccatcccttctgtcag

SEQ ID NO: 40405 - DNA, 205 bp, Homo sapiens
agtcctgctgctgaaagagcaaatccaaagactgagttatgtttaatgacttttggccgaatcactggaaatatctgtggtgagattgctgagtcaggtgatgtgatatcataagctttcttggaacgggggaaagaaaatgaaactttttggtgtgaatattttttatgctgatgtgaattattttgttaggtagtgtgattat

SEQ ID NO: 40406 - DNA, 497 bp, Homo sapiens
atagggtgtgtgtgtgtgcataggctcatggaatagattcatgcaattatggagactgacaagccccaaaatcctgcagggtaggcaggcagccctgcagaccccaaggagtgttgatgttgcagtgcccagtctgaaggctgtttgcccagcagaatcccctcttgcctcaggagaggtcagtctttagttctattaaggccttcagctgattggatgaggcctgcgcacattatacagagcaatctgctttactcaaagtccacaaatttaaatgttaatctcatccagaaaacaccctcacagaaacatccagaataatgtttcagccaatagtagggcttaccacttcaaaggaacaaataggaaaagataacttattttgttagcttaacgttttaaattcaagttaatcatgaaagcttttttcctctgtaaccagagtgcgctttcatgctatctggactcacttgaataggacttacagagtatgttct

SEQ ID NO: 40407 - DNA, 652 bp, Homo sapiens
ctaaatccttgggggctagttcctttttctggaagtttcagaatctaaggtccacatccctgaatcccagaataatgccttggctatcacaaacatgggagcccagtaattagtctgattagtacaaagttctctacattctctctttcatccttttctaacatgaataggtttattttctaagttctgctaggatgtgaagaagacccaaacacagcaaactggattagtttatgtattttccaaaattttactgaaaacagcattgtataacacaagaaattgccattgagttcccgagttgcccaaatcaggcttgttacctagcccaccaacatcccattcctcatgtgctgtttccacccacaaacgtgtatatgtacagcatatacaagctctgcattcctgacatgatgtgttgggagataaagatggagccttgcaccagtataatctatttgtgtctcgaaacagtaccactatgaaagcacgctggcttagtgtggagtagaagaaatggcacaggaattagagcctggagaccagaattgggtagccctggggaagtcacttaacttatttagatctccaattctttatttttttaattcagtttagaaaactttttattacataatttttagaaatatac

SEQ ID NO: 40408 - DNA, 447 bp, Homo sapiens
agcagctctgtctccctccatgcccactcccattacaggacaggagatggatttggattgtggggtgggcccaggaagactgggagtaacctcccaggggcattcttacctcctcatctgtcataacagagtagaagccaggcattcccagggggcagcaaatggaattcagagagtgccaataggaggagaaaaagagaaatttactaaagatgcccagtggacttgggcaaacctggcccaatcccttcctagtgcaagtggcccaaacaacagcagctagtatttactgagtgctcactgttgccaagcaccgtgctaagtgttttattggtaataacttgtaataatcctcacaataaccctaagagggagccattattctcagtaacagatgaggaaactgaggcttggagaggtaaaataacttacccaaggtcacagtca

SEQ ID NO: 40409 - DNA, 305 bp, Homo sapiens
catcctttgcagcttagaaaaatataactcagtacaccatacagcatatttaaattaaaatataaattatgtacatcattattcttatggggggggagccgctgggaaaggcatgctattctataaccctggacaaaatttgacttttgatgtgtgaattcttaaatgtgcacaaaccaaagacaatggcatatatactttgacacattctgaagttaaaagaggacatgaggattgtgagataagtggcgattgtgtctactattgtaataatataatgtctgcatgacaagaaaaaaagtaaa

SEQ ID NO: 40410 - DNA, 280 bp, Homo sapiens
ccaccctgccgcacagctgatacctcagagtttatcattgacttccttttcacgactccacccccaacccctgtgtatcatcattccctgagcgcctcctatgttccaggccttggggaccccgagctagtgaaaggcccacaggctagtggaggggagtggatggcgcttggttgagtgtgagcaccagtggcaagggacccctctccccatcaggagggagccctttgtaacctgatagtatcattaaataaaagtttattgtgtttttttgttttgt

SEQ ID NO: 40411 - DNA, 411 bp, Homo sapiens
acaccatgtggaggttctctcacttttccactgacaatttccaaattagcaaaatggtgataatagttgtgactacatcctaattatcttatgagaattgagtttatattaatatatataatggtgacaacaaagactgtcatataatcagtgcttagcaaatgttacctatcttattttatttatctatttatttatttttgagacgaagtctcgctctgttacccaggctggagtgcagtgatgcgatctcggctcactgcaccctccacctcctgggttcaagtgattctcgggcctcagcctcctgagtagcagggactacaggtgccctccactacgcccagctagtttttttgtatttttagtagagacggggtttcaccatgttggccaggctgttgttgaact

SEQ ID NO: 40412 - DNA, 477 bp, Homo sapiens
ctgcctcagcctcccaaagcgctgggcttacaagcctgagccaccgtgcctggcccttctttcttcatatccttattctgtatacttttttctattttaaaaaagtaatttttttactttttaaattttttttgcttaaaaacaaaaacccacacattagcctaggcctatgcaggctcagcgtcagtactccccactcttttttaaatgttgtgaaatcctcacctgcatcctaagtattgttgtccccccaactcccactccagagaaaggaagtgatttaccactggccacatggctagctcatgccagctcaaaggccagagctccagtgctcatgatctccatcgagctaccaaagagagttcatctgagcaaatccatatgcaccgcactgtctcagggccaccaggagctcagaaaagggagctggcttttgccaaagaagtaagtgatggcaaagtagaggacacatga

SEQ ID NO: 40413 - DNA, 465 bp, Homo sapiens
aaagctactaaagaaaagccagaaacagcgtaagaatgccctactcaaatatgattcagagacgagggtggggactttattccactggacttcagtcccagtgacaaggccactactattgtgaattaatatcaggctaattaaacttgatgttattaaatgttctatccataaaatttttcattcagaattcttgtttttcaaacaacattctggattattatttagctgtcaaagtagctgtgttcttagaaaatacatcagtcagggctgggtacagtgggctcatgtctgtaatcctagtgctttggggaggccaagacaggagggtcacatgaggccaggggtttgagacccaacttaagtcaacatgggtagggaccctgtctctattcccccctcttacccccccaaaaaattagttcaggacagggtaggcacatgcttgtagtcctagctacttgg

SEQ ID NO: 40414 - DNA, 323 bp, Homo sapiens
tttattatgagcaagatgttatagctagtctctaaaatagtgtgttagaataaaatatagttggatattatcaacagaaatcaaatatagagatgaatctctgaacaacacattttatttgagacagtagaattgtaatttgggcatacacacagactgcattggtctttggtatgtccaaagaacaaagaaaagattgaggtttttattagagaaatgttatgcattgttttgaaagaaaatgcattggcactagcgaagtttttgggagctggcatgctctgatttgtgagtgactgtggtaggtaaaactagtcttagag

SEQ ID NO: 40415 - DNA, 485 bp, Homo sapiens
gattatttggtgatggaatcatgtgggcagagggaaatgatctgtttgtgctcgaatctgcctccaggtagggaccacatgactggctgagccattagtcataggtatgaatgaggtcagccggttgccagaatgcaaaagaatgagaaacatctcaaaagaccaatctcatgttctacaatagtgatgttatctataggagcaattagttacaaattttgtaaactctggccaaacaacattgcagcagtcaggaattatagaaactgtgccaacattttagcagaattcagttccctcctataatcttaatctcatggtctttcactagtttgacaaaggccatccctgggcaaagtaaggttgttagtttcatggaggaagttttgtgattcttgcttcaaagtcaaaccataaattaaattcctcccaaggttagcctggcctatgcccaggaatgagtgaggatagccagccagagacta

SEQ ID NO: 40416 - DNA, 138 bp, Homo sapiens
gcacagctgcgtgagtgagcctaggccaagctagcggaggaaccacgcagccaacccgcaggatggcggaaaagaataagccgtggttgattccatcactctgtggcgggcagcttgttacacagcagtagaagatgc

SEQ ID NO: 40417 - DNA, 743 bp, Homo sapiens
actgaattttttttttttttttttgagacggcatttcgctcttgttgcccagagtggagtgcaatggcacaatctcggctcaccgcaaactctgcctcccaggttcaagcaattctcctgcctcagccacccaagtagctgggattacaggcgtgcgccaccacgccccactaattttgtattttttgtagagatggggtttctccatgttggtcaggctggtctccaactcctgacctcaggtgatccgcctgccttggcctcccaaagtgctgggattataggtatgagccactgcacctggcctcacccactgattttttttttttgcctggttctctggaattatctcctataggctgtcaatctatgatggatactgatatatcctagtgctaaaagagtgcaagcaaagtgggtaagctctgtggaactgtcctccaaatttcccttcccccagggcaaagcttctacctctgtccctcataatccagtacagaggctacagttcaaccaatcgactttaatttttttgccctatttcatcaaccagtttatctatcccacagcagtttacagagaaaacagatttcacaatacaagaataaaacactctcaagtcaaagacttgaccttaggcttttagtaatgaaattttcaatgttattcaggaaagaaaaaaatctaaaggtataaaaattactgtcaaaataagtaacttttttttttctttggagacggag

SEQ ID NO: 40418 - DNA, 822 bp, Homo sapiens
aactttaatggaacaataaggtgtttttgataaaccacatgagttattttcattgattatcttatgacagttgttatcaaaatggattattacatatttatctagtatttgctgtaaactcagcagtttggaatacatcagtaagtatttagttttattatgctactagagtttttttccgtattatagaattttcaaacatttactaaggtagataaaattttaatagtttaatgaacctggtttaccatttaatcagcttattagtaatcaatacatggccaatttcacttcatttacacctccacacacttccctcatattccttgttattgccttaattgagatataatttacatgtcctcaattatgttttggaaaatggagacatagtttcctctacaaatatttctgtatgcctctctaaatattaatgacttaaaacacaaacagaccctgacaccatatgaccttaggacaaattagcaataacttcctaatgtataaaattaaatatccagtcagttttcaaggtttccctattgtcttgtaaattattatcatcttctttattttatagttattttaactgggatccaaataaggactatacattaaaattagatgaaaatatgtcttgtttcctttgatatctttgagtatatcacctacgtgtgtcacctacatcttttttcacttgcactcttttggtttattttgttttgattgaagaaaccagattatttatcttgtagtattttgacactctgcatttttcggattgcatttcgtggtatttattaaacctgtgatataatttga

SEQ ID NO: 40419 - DNA, 287 bp, Homo sapiens
aactttaatggaacaataaggtgtttttgataaaccacatgagttattttcattgattatcttatgacagttgttatcaaaatggattattacatatttatctagtatttgctgtaaactcagcagtttggaatacatcagtaagtatttagttttattatgctactagagtttttttccgtattatagaattttcaaacatttactaaggtagataaaattttaatagtttaataagctgattaaatggtaaaccaggttcattaaactattaaaattgtcgacgc

SEQ ID NO: 40420 - DNA, 433 bp, Homo sapiens
accccttataaaaccatcagatctcgtgagacttgttcactgccacaagaacagcatggggaaaaccgcccctatgattcaattatctctcactggctccttcctacaacacatgggaattatgggagctacaattcaagatgagatttgggtggggacacagccaaccacatcaggaatctctaaaaaagtattgaatatggagaatgccaaaaagcctgatgaaggatacaatttttgtatgttagaattatttcgtatttcaagttaaactgttttccccagccatatttgttcctactctttttttttaccttcagcctgttgttgacataaagaaataaactgaggcaaaaacaggtaaatatttatatgggccaaggttgaggactgcagcctgggaaacacttccaaattaccttgggaagtgctc

SEQ ID NO: 40421 - DNA, 369 bp, Homo sapiens
cagacagtgctttgagatgggttttatgtttatttaggtgggcttggggtggggggttttgtgatagccagcctttggtgcttgtactactctcaaaccatacccgagccacatgtgcaggcatgtgtgtagagacttgaggtgtactgacccaacttgtcaccagcctgggctctcagaaggtttcagaagtttgttcttctctctgctcgatgggagttaaaaagtatagcagtggagagatccagtgtgagggcctggacttccaaccttccagggagagctgggcttgggagactaagaactcctcaggtatgcctgaacatgcccagtagtctatagcaaggactggccactgaaacacaacag

SEQ ID NO: 40422 - DNA, 437 bp, Homo sapiens
ttaaaacagtacaaaaaatgtacattgtgtacttactgtgctaggtgctggaaacacgaagatgaaaagagccagagcctttgcttttcagaagctcatggtctgttggagcaatagacttgaagaatgtgatgaggagggtattaattaaaagttgtaggccaggcgtggtggctcacacctgtaatcccagcaccctgggaggccgaggcgggcagatcacgaggtcaggagatcgagaccatcctggctaacacagtgaaaccccatctctactaaaaaatacaaaaaattaaccaggcgtagtggcgggtgcctgtagtcctagctattcgggaggctgaggcaggagaatggtgtgaacccaggaggagatcgcgccactgcactccagcactctaacctgggtgacagagccagactccatctcaaaaaaa

SEQ ID NO: 40423 - DNA, 415 bp, Homo sapiens
aaagatgaaatggtttggatgtttgtcccctccaaatctcatgtggaaatctgaccttcggtgttagaggtggggcctcgtgggaggtattgaatcaagcgggtggctctctcatgaatggcatagctccatcccttggtgatgagtgagttctcgctctgagttcacaggagatctggttgtttaaaagagagtagcccctcccctctccttgctccctcgtcatgtgacacgctggctccccgtcaccttccaccaggagtaaacgctccctgagatctcaccagaggccaagcagatgccagtgctaagtttcctgtaaagactgcagaaccatgagccaattgaacctattttctttataaattgcagtctcgggtattcctttatagagatgcacaaaacagcctaatgc

SEQ ID NO: 40424 - DNA, 351 bp, Homo sapiens
tgagacacagtctcgctctgttgtccaggcgggagtgcagtggcgtgatctcggctcggtgcaagctccgcctcccgggttcatgccattctcctgcctcagcctcctgagtagctgggactacagacacccaccaccatacctggctaatttttttttttttttgtatttttagtagagacggggtttcaccgtgttagccaggatggtctcaacctcctgacctcgtgatccacccaccttggcctcccaaagtgctgggattacaggtgtgagccaccgcgcctggccatatgctaagtattcttaaagtggtttgtaaaaaaacaatttgcttagcagaggcacaag

SEQ ID NO: 40425 - DNA, 867 bp, Homo sapiens
gatactaaatggtttttgccagcaaaaaggagtgaacctacttcttaaaacacccgagtaaccaagctgctactaagactagaaggatgctaattctggcaaaagtcaaaggttactaacaaaaattagctaagattatatgtttgcagaaagtcaattcagggtaattccgctattatcctgttgtgtttattattcctaaataactggcaattccaccttaaactacggtgcaaaaactaaatgcattaagaaactaattgggaaataaatgtgtttttttaaataaaaacaaacgtacttaggtttttgaagggaaacagctatcaatcttcaacagggctttttaaagcctctgcaccagcaaataaacctttcaggttaactaaacacacttgtgtctttgaaaatctagtttgagaaatcctaacagcagtttgggacaagtgatggagccaccgccctccaccctacaccaatttcactgtcagtacatgcagtgctaacagtaagatcagctgtgtcttttattaggaagcatgttttattgggggcaaggaggggttcagttaggtgctaagaatgtgtcctgcataccgctgtcactctcagtactcaaaaagtaaacatatcaaagccagaagcgtaaactggcatgacaagactaggaagagaaagtaggggacaaagacaaaacagaaattggctggagaaaataaatttagacaaacaatttacaactttcacttagaccctaaggcaacacattccagccgacccaacgcgctcagccggggcgaccgtgaaactactgagaacaacaaagaggagcggcggccgcggcaggagtcccgtccgagtttaact

SEQ ID NO: 40426 - DNA, 452 bp, Homo sapiens
ttcaaatccgtggacctacttgatttaaaactgaaattgggaaaggtgtcccttttcctttccaaaaccacatccctttataaagtctttctctatcttgagcatttacctgcctttcttctggcttcatcctattaacatttaaatatgcttatcctttcttcttaggagaaaaaaaaaattgctttcctctgtgtcgccttatatccattgctttttctttttgctctatctcttgaccccacctcaaacgaatttctgccccaccaaagacagtaaccccttttatgttaaaattagtggaaagaatgttaatataatgccctaactttaaagaagaacataaaggaaatttataagtacttccagggctgtcatctatgccgtgccaatcatgcagtgcacaattccaagggcaccactttacattacaaatacagtgcattacaaat

SEQ ID NO: 40427 - DNA, 190 bp, Homo sapiens
gtgagctctcccaggtcgtgttgggtggatatgctcctgggagctggtccttttggaatggaggctaaagggagatgctcaccgtgtaaccacagtgtcgtctcatttccttgccctgtcccttccccaccctgctgagtcccaggtgccatcatcaccaccaccaccctgcccatcatgagtatttcat

SEQ ID NO: 40428 - DNA, 423 bp, Homo sapiens
gccagctagtgagtcaaggaagtgttaaggttatcgtcttatgctagatagagcctgggaaaggaggtgggtcttggaaatttgcggttcataacagggttgtctgtggggctggcagaaaggtagaatatgactctgtggatagagatcagggaaaaaataaagactgcagatttggggctgtatccatgtataggaaacatgagcctgacaaaaaatagagatgcagaatgagggaaggtgtggtcacttctgtaaaaatctttcaaacactgatttttgaacaattcattgctcttctgcagttgaaagaatcccaaaggaatgacacctgaatggaaaacctccaaagatcccttctggttggaggccctgggtctccaattgacccttcaaatatattattctgttcttttgtgcatt

SEQ ID NO: 40429 - DNA, 433 bp, Homo sapiens
gggattacaggcatgagccaccgcacccgtctggcttgctaatacttaactgtcagagttgagcatatcaactcccccagtgctgaacaacccaggcctatcctgtaaaacctaaaatatggaagacctgagaaggtgcatgtgctctgcaggcagaaaagcactgaagaggggaaggggctggctacgggtactcagttcttcctcccaaactcactgatccacgcgccttcatctctggggaggtagagaagacagccatatggagaaggcaattgttttcccaccccttcaaaagaatgtacatgggtgtgtttccatctgtgatatgctaaaatttaatctactctagatagatttttatattaaggaagagtaagcacattcctttataaacagaaacttgtagaattttatgctgcttcttcatagc

SEQ ID NO: 40430 - DNA, 157 bp, Homo sapiens
gggagaatgtatgctttattcattgagctctatagaacataccagcatttctctcatagccgagctgttttaaatattaaggtaaaatatataacacaggaagctcttcaagaaaggccaattgaagtgtagctgtttagagacaactcaagatgat

SEQ ID NO: 40431 - DNA, 2518 bp, Homo sapiens
ggaggctgtcactcagagacaggcagaatcaagagctggtcctggagagaccagtggggctgtgtagactgggagctttggttgtttgctgagagcaggaagctgcaggaagaaggcagtggtccccagccagaatacggagtggcttggaggtggtcaaaggtttgaagacagccacagtaaagtggacagagacaagaaaaataggtaccaaaccgtgcatccaggtagtcacagaaaggaaatgggtttagattgaagcaatgtgggttaaagttagaccctggggaaaccttgcaggggtctgtaggcctgtgaagaactggactaggtgagaagaagaagcttttgacccatgtcactccctggcccagaactatatcctacccacaggtgggttgagttcaggactgctgcttccagcccccagcagcaaggttcaagtgagagctgactcacctagggccccttgttagagcctcagagccaggtgaaaagccacacacaggctgggcgcgatggctcacgcctgtaatcccagcactttgggaggccgaggcaggtggatcacctgaggtcaggagttcaagaccatcctggccaacatggcaaaatcccgtctctactaaaaatacaaaaattagtcctgcctggtggcacatgcctgtagtcccagctactcgggaggctgaggcaggagaatcgcttgaacccgggaggcggaggctgcagtgagccgagatcatgccactgcactccagcctgggtgacagagcgggactctgtctccaaaaaaagaaaagccacacaggtgtgtgtgtaggggcaagggagtttcctactgtcttcctagcagaaaatggggagaaactgttaaagccagaatgagggagggctgtgtgtggcctgggactggcaacagaagtgtcaagctgccaggtttcaggccagtacagagcacggttctacctgggttatgtgttgccggcactaatggttagagacatctgtcactggtgagggcagaaatgtatgcaggagtgggtgtgggaagctggcctcactggtgggtggggttggagactttgccaggcctggtcaggaaaagctgctacaaaacagcaaaactgctcctagtgcagcgatccccaacctttttggcaacagggagtattttcctggaagaccatttttccatggagagggagggcggggctggtttcgggatggaagtgttccatctcccatcatcaggcattagtcaaactctcctaaggagcacacaaaacctacactcctggtgtgcacagttcacaggagggcttctgcttctgtgagaaccaaatgtcccactgatgtgacaggatcagagcgccatcgctgctcacttcctgcatgcggccctgttcctgacaggccacggaccagtacctggggtttggggtcccccgccctaggggatgaaagaagggaaacctgggtctaatgggttactgtgattctccctgcgatgcagggaagagacaggacagaggtgggaaggaacatggtcaccaggagtcgggacagcactcttccaggtccttcccctggggctgagtaagcaccctgcgcgtagctcttcctggccgcctgtgggctctgggatctaaacggactatgcagccattctcactttcattcacagctcggacagggacagtgtgtgttgaggcggaaagacaaaacatgtatgtgagagactttgtatgagccggttcctgatgaagtcctatctttcagcctcgtatttactgcccaggcagatggggctcttttcttcaccctcccgctttttttttttgagacagaaaacttaatagaaattttgtttgcagttcttacattctcagtgtgagccaatctgtgacccaccgccccacccagaagtggcccagtcctggtgcagggtaggaagggaagggtggagtgagaagagccccatttttcctcagtgccagggggctggagacaccacccccttctcctgcctctgggctccaggaaggagtgcagatggactctcaggcctatggttcctcctccacaccactgtcccccaggttggaggggagtgagagatacagggagagaaggggacagaggcaagaaaaggtgttgatcaagaaaggcaagaaccaggggtgagggctgacagagaatcaaagataaaacactagtaggccgggcgcggtggctcatgcctgtaatcccagcactttcgggagccaaggcgggcagatcacctgaggtcgggaattcgagaccagcctgaccaacatggagaaaccctgtctctactacaaatataaaattagccgggtgtggtggcacatgcctgtaatcccagctgctcaggaggctgaggcaggagaatcgcttgaacctgggaggcagagattgcagtgagccaagatcatgccactgcactccagcctgggcaacaagagcgaaactctgttggaaaaaaacaaacagt

SEQ ID NO: 40432 - DNA, 361 bp, Homo sapiens
gggattgtgactttgagcttgtgatccccagtattctggggagatgttgtgaaaggcccaagtgttccaggcaggagagctgagagagctgagtgtccatttttccttttgggacacagtccccaaacactgtttgtttctcactgccaagaggaactacacatggtcttccaatatccctgccatggcattaaagccaactgttctgtccccctgcccacagatggaggagtaggagagaaaagaaggccacaataactacatttcagtccgaattccaaatctttcttagagcttaagttggttgttatctccttgttcctgtttggataaggttttattttctaggcttcccttcttc

SEQ ID NO: 40433 - DNA, 1561 bp, Homo sapiens
ccagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgatgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcgg

SEQ ID NO: 40434 - DNA, 1334 bp, Homo sapiens
ccagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgatgagatagaaattgactttgagactctgaaacccaccactttgcgggaactggagagatatgtcaagtcttgtttacagaaaaagcaaaggaaaccgttctcagcaagcgggaagaaacaggcagccaagtcgaaagaggagctagctcaggaaaagaagaaggagctggaaaagcgtctgcaggatgtcagcgggcagctgagcagcagcaagaagcccgcccggaaagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaacctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcgg

SEQ ID NO: 40435 - DNA, 411 bp, Homo sapiens
agctacacaatgtattgtgtctatcatgttaaaacatgcattagacacaaatacaaaaaccatgaaacaagccaccattcttcaacaatttgagcaaagataaaatgcctaagtaacaacatggatgacttgcaaaggatgggctctttactttaagcaccataaaaaaaaaaagcacaaatggatgagtgtgttcagttatatacactgaattgaacctttggcactaggaatcagagtattttgtcatatagcattaacatgtattataaaagtgcgtagtgtcaaaggaatagaaccaccaacattcaaaagcagctttgtcaactaggcagtaaaacactctacagcatatcctctgttgtccatcattgaatacactggtagtgactttgaaattaaaaaaaaaaa

SEQ ID NO: 40436 - DNA, 527 bp, Homo sapiens
tccctgcaatgatcctatgagataagccactgctcatcaccccattgtacaactgcagaaactgagactcagggtggtcaagggccttgcccaaggtcaccttgctggttgggcagagagttgaaccccaacatctgaccctcccagagcccctgagctttactgtcacaccatgctgcctgcagaaacaaagttgtaaatgacaggtaatgaaaattaccccaccaaggcccagcctagattaattgggttttagggcccagcttccaaacccaaccaactgaagacactctggggtgacattaggcaccagtgaccagcttgcacactgatcccagagcctagccagctggagtaggtggctaacaaaagggtgtgggccctgagtagggtgattagagagagggagggggactctaatcagggaccccacatggcaacaggcaaaccttttgtcacatcatgccttcccctccccaggcactgagctcaggaaggtagacacagggctgctgaaatgccacatc

SEQ ID NO: 40437 - DNA, 447 bp, Homo sapiens
  misc_feature (12)..(12): n is a, c, g, or t
  misc_feature (43)..(43): n is a, c, g, or t
  misc_feature (64)..(64): n is a, c, g, or t
  misc_feature (70)..(70): n is a, c, g, or t
cggggttgaagntcccgaagaaaaccgtccccctaggccaatncccctccaggtgtggaaccanccatangagagtaccttaccaccaggcccctagaagggtaataagccccactacacatctaggctatgagcctgtatagcatgttagtgtactgaatactgtaggaaattgtaacacaatgatattcatgtatctatacatatttaaacatagaaaagttagttacagagtatatggttgtatagtcttatgggaccactgttgtatatgcaggttcattcgttattgatcaaaacatcattatgtggtgcttgactgtacctacaactatctggcagcttcattgtaaaaagtagcatttgaatgagacttgttggatgaataggaatttcccagagggacaaagtacaaggaatggtatttgtttaaaaaaagaaaaaaaa

SEQ ID NO: 40438 - DNA, 828 bp, Homo sapiens
cagtaatgtcctaggccttcgcattcactcacttattcacccagagcaacttccagtcctgcaagcgccattcatgataagtgccctatacaggtgtgccatttttaatgttttatactgtatttttgctgtatattttagatacagttgcctacagtatttagtacagtaacatgctgtacaggtttgtagcccaggagcaataggctgtatcacatagcataggtgtgtagcaagccataccatttaggtttgtgtgagtacaccgatattcccacaactataaagtcatccaaagacgcatgtctaaggatgtatcctcattaagcaacccatgactgtattttgagtttgaagttccaatggtacatctaaatggatctggaatgtgggaagagaatattcctgaactaaaaagaaggaaattagaagtcattttccatggaggtgatgattaaagctttgttaataggtgagattgccaaaaaagtcctagacgaataatagagttgtaaagaaaccttcaataacaaacaaggaggaaacagagaaatagttgaagatgtaaaagaaaaccaatttaggaggctgatgcagccggattacttgagctcaggagttcaagaactgccctgggcaacataatgagatcctgtctctacaaaaaatagaaaaattagatgggtacggtggcatatgcctgtgtcccaaatactcgtgatgctgaaatgggaggattgcttgagcccagggggttgacgctacattgagccatgattgcgccgctgcactccagcctaggcaacagagcaagactttgtctcaaaa

SEQ ID NO: 40439 - DNA, 358 bp, Homo sapiens
cctcccaaagtgctgggattagaggcgtgagccaccgtgcctggccttgagctacacttgtatcaagcactttgacacttactatcttattgataagtccttgagggggttgtcaagcagggactgtagggactgttcacactcaaatttcttccttttattgttttttgtttgtttattgtcttcttttacagcctctggggatataatctgtcatgggagcaccagcttctttttcttcttcctgttcagtattcattatctggaaggttcctttcttgcggtctttcctttttaaaggctgtagtaaaatgaggtacttagcctaaaagtttttctgactctaaggaaaaaaaaa

SEQ ID NO: 40440 - DNA, 2861 bp, Homo sapiens
aagccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtggtatcccgaagcctaatgagcaccgcgatcggcgggtccctggagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40441 - DNA, 1722 bp, Homo sapiens
agggaaaagaggcctcggatgccagggaagaggaggccagagaagggcgaaacctgcaacgtggcggggtctaaggaaggtcggagctcgggggaatacgcaggttttggaagaaggcgggagctgacgaagaggaggggcaccaggaaaagaggcgctccccagagagggcggggtttgggcagggacaatcctatccggaggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40442 - DNA, 2250 bp, Homo sapiens
tgcaccctctgagtcccgctaggggaaagtggggaacccaaggaggacgcaggtcctgggtagggaaagccgaggcccagcctaagtcttggcggacatcgcctcttgcttcccacagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40443 - DNA, 2667 bp, Homo sapiens
aagccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtaaggatggcgggcagcaggtgcgggacggggaggggtcccagcgggcggagtcccttgacacttccggataccttcctctgcggtccgcccacaggtggtatcccgaagcctaatgagcaccgcgatcggcgggtccctggagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40444 - DNA, 2763 bp, Homo sapiens
aagccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtaaggatggcgggcagcaggtgcgggacggggaggggtcccagcgggcggagtcccttgacacttccggataccttcctctgcggtccgcccacaggtggtatcccgaagcctaatgagcaccgcgatcggcgggtccctggagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctgggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40445 - DNA, 2345 bp, Homo sapiens
aagccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtaaggatggcgggcagcaggtgcgggacggggaggggtcccagcgggcggagtcccttgacacttccggataccttcctctgcggtccgcccacaggtggtatcccgaagcctaatgagcaccgcgatcggcgggtccctggaggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40446 - DNA, 1547 bp, Homo sapiens
  misc_feature (64)..(64): n is a, c, g, or t
gcagaggcgaagctaagacacggatcggcggcctggagggcaaagacctggaagctaaggtaantagctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40447 - DNA, 1000 bp, Homo sapiens
tgcaccctctgagtcccgctaggggaaagtggggaacccaaggaggacgcaggtcctgggtagggaaagccgaggcccagcctaagtcttggcggacatcgcctcttgcttcccacagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctgtaagtgactggcctaaccctaactttgtcccctcaaacaacctttttactatgcccagagaagtcatcttacaggtggtctggactcatttcgacccagctctcaggcactgtgtaacctgcagatgttgggctggagaaggtggaagccatactagtgtatgcatgtgcttggccctcacatgcctcctcacgcacacactgaggtctccacttgagtgatcttcccttcagcctattctttctctgtgtccccattccagggatggccccctttccccatccaccagactagaaacttgagccttgttttagttgcttccttcccattttctagctagcctgtcaattactgagtcctcctcactctgcatggacaactctgtagtccatcccttgtgctttctatgcctacctctgctgtcctgctgggaacctccattctttct

SEQ ID NO: 40448 - DNA, 1020 bp, Homo sapiens
agggaaaagaggcctcggatgccagggaagaggaggccagagaagggcgaaacctgcaacgtggcggggtctaaggaaggtcggagctcgggggaatacgcaggttttggaagaaggcgggagctgacgaagaggaggggcaccaggaaaagaggcgctccccagagagggcggggtttgggcagggacaatcctatccggagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagacatctttccagaagtacagaactgggtaaagctggcaagaggaggccgataaagggggaaactgaattcaaacccttgtcaatcccggggtggggtcaccttaggtctgggacatctgggtgcacgtgtaaatagaaagaaaggttggtttgggagaaaaaaaaatcccgaggatggtggattatacatgtgtccaggaggtaatagacaggtgtgaaaaatctttttttcgagctaagggcgttgttggaaagatgtgaaatacgacgagagttgatagtgaatgtaatgtgtgagtaatggtaaagtagataattatgtcaagggggagtatattagattatagac

SEQ ID NO: 40449 - DNA, 2235 bp, Homo sapiens
tgcaccctctgagtcccgctaggggaaagtggggaacccaaggaggacgcaggtcctgggtagggaaagccgaggcccagcctaagtcttggcggacatcgcctcttgcttcccacagtgccgggcggcggtgtccgtcgccttcgctgaagtggagcggcggctgcgctcgggtggggcggctcaagcagcattgcggacggagctgagcgcttgcgggcccctgggccgcgctgaaaaccaggcggagctgttgggggcgctgcaggcactggtgggaggtgtagtgcagtatgatgggcagacgggagcgccgctaagcgtgcgacagctctgcggacttctcctcgggggcgggggcaaccgcagccactccacgccctactgcgggcttcgtcgggcggtgcagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40450 - DNA, 2487 bp, Homo sapiens
aagccgaacaccatggccgtctggcttgcccagtggctgggccctctgctcttggtttccctctggggactcttggctccagcctcccttcttaggcgcctgggtgagcacattcagcagtttcaggagagctctgcccagggcctgggcctgagcctggggccaggtgctgcagccctcccaaaagtggggtggctggagcaactgctggaccccttcaacgtgtccgacagacgatccttcctacagcgttactgggtgaatgaccaacattgggttggccaggatggacccatattcctgcatctagggggtgagggcagccttgggcctggctcagtgatgagaggccatcccgcagccttggccccagcctggggcgccctggtgataagcctggaacacagattttatggcctgagtatacctgctggaggcctggaaatggcccagctccgcttcttgtccagccgccttgcgctggctgatgtggtctctgcccgcctggcactttcccgcctctttaacatctcctcctccagcccctggatctgcttcggaggctcctatgccggctccttggccgcctgggcccggctgaagttcccccatctcattttcgcgtcggtcgcctcctccgccccggtgcgggccgtgctggatttctccgagtataatgacgtaaggatggcgggcagcaggtgcgggacggggaggggtcccagcgggcggagtcccttgacacttccggataccttcctctgcggtccgcccacaggtggtatcccgaagcctaatgagcaccgcgatcggcgggtccctggagattgtcttgcacagcctgggccagaagtgtttaagcttttcccgagcagagacagtggcacagctgaggagcacagaacctcaactgtctggtgtgggtgaccggcagtggttgtatcagacatgtaccgagttcggcttctgggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctgaatctcataccctttccactccctgcatggtcacctcagtcctggacatacttgttcactgaacaaaagaaagcagcttgttttgaaagaagaaactcccaggaattggaattcagcacctgttccgcacgtaattggcatgtgtctgcaaacatccttattcccaacttaaagtgctttattgcagagagttatggaaatataagtggatgattattctcattgtaaatattggtattttgaatgttaaatgtcaaacaaatgtgacttatgctggtgccctcgccctgctgatcagattctggttcaaattctgccactccagctcctgggttaggggctttgctgtaagtttctttttctggactttagatcctgaacctgtccttgcttctcagtttctctcactgtacccctttccctcagtctcttcctctctctttcccctgtcactatttgtctttctaatctccttctgtttctctgaatatcttcatttctatctctgtgtttctgtctatttctctgtttatctttctgtccttcaatctgtgtttttgtttctggctctccgtcagtgtctttttctctcctctctctcttgctctgccatggctatttccactgctctatttctgactctcatttttggtctctgtgtgtctcctagtcactttctttctcactctgtctctgtctctatttctgtctctcctctgctgtgtcctcaatctctctgtctccctgaggctctatttctgtctctcctctgctgtgtcctcaatctctctgtctccctgaggctctatttctgtctctgatgctcttcttctgtgtctctatttctcttcctgtcacttaatcttttccttctctatctctcttatttagtcttccttccacacccttcactcaccatcttttcccacaatcaaatatcactccctggtacttccagcttccaactctagggattcatgattctggtggagattccttcttccagggcctgggaggatagggctaatcccaagggtgcctgcttaggctatgttagctgtgacaggaacctgccatagatttgcactgttctttcctaaagatcaattattttcagcaataaatacttctcagctttttgtatgtctttgtatgcacagagatggtagttttagagttttatccagtttcatatttccttgtgggtaagaggcaacctcctcatgctgtcataccaaagtcaatctccactacactttagttctgcctgttcttgatctttatataaatggaaacttgcagtat

SEQ ID NO: 40451 - DNA, 386 bp, Homo sapiens
cactgcccttactagccatgtgatcttgggaaaactacttaaaacctctctgagcctgtttccccatctctaaaacgggcttaatccagagtatctaccccataggttggttgtgagaattaaataagctcttacatgtaaagcagagtgttttggcacacagtgtgcagtgttagttggtattatcatcttcagggcatctctaggggacgaactccaaaagccatgggtgcgtgtgtgtgtgtgtacatgtgtgtacacacgtgtgtttgcacacacattcacgcacgtgtatatgtgtgttcatggcatacagaagtctccttgcttctttttctctctccagagatttaattatcaccttcttttttaaagagaaaactagg

SEQ ID NO: 40452 - DNA, 509 bp, Homo sapiens
ctaagtctactctggaccatgagcaaggataatctgtcttagaggagagaaggtgaggttatgattccagagcatttggtgacccaggaagtagacctgcctcctcctatctgtccacagagcagtcctaggggcaataggccatgagaagatcatgccaggcagtccatttctatattaccatgtaaacaaaaactcagctgtgaaccctggaacgttcgtattctgcagctgccagtgtaaactggtacaggcctcttgaagaacagtggggaaaggcactctgaaagcatccacgcctccatacctgctgatccagggctctgattttccttctgggaaccaagcctaggagaatgattcaagctgcagaaaacctttctccactaagatgtttgctgtggcattcagtataatagcacaccagagaaacaatctaaagattcatcagtaggagaatatctaagtaaattatggtacatacactcaataaaatgttatatgactac

SEQ ID NO: 40453 - DNA, 480 bp, Homo sapiens
tagtctgtgatcttcctttgcagaatcacctggcatattttagactataatcataaatcataatatgccacttactataaaaaaaaagacagaggacattaaagtttgaacccagtgcttttcctatagactataaaatggacactgaaagttaatgtgctctattattattcctaccgttttataaaatagatttggctgccctgaacatttgtcaatttaaatgaatgaataataataaaagtaaaatgaaaatacagttaaatagatacaatgacccaagatcctcttgagtacaagcataactttgtattgaaaaggtaaaatggaccaatagaccaaagctttatcattggttctatttttacttgtcaacagagcccttaagaagggactgtgagtagtcatgagagataagcacaaattataactgttggctactttttaggatttgtgttccagctctgcacccagggtatt

SEQ ID NO: 40454 - DNA, 449 bp, Homo sapiens
  misc_feature (2)..(2): n is a, c, g, or t
cnactccctgacccttcagggtgatcccgccctgcccttggccctccccagagtgctggggattgccaggtgtgagccaccgtgcctggctaccattttttactttatataaatggaaggagatagcttagacatgtgcctccaaaatgcttctcattgttgctattcatagcaaagaagttaaaatcttgacctgatgttaaatcacattctgaaagggcgagataaaaagagtgttcttttctaatttggaaatacattaaggattaaggatgagaatggagaaagggattacagtaacacagaaataagttctttctccaaaaccatctgatgatctgtgaagaggccctaaggatgaactgactgcatcagacatgttccatgccatgtgtaggttgtgacagaatattcatacagtaaaataaagtgacttatattttggaaat

SEQ ID NO: 40455 - DNA, 583 bp, Homo sapiens
aactcaataaataaataaatgaaggaaagaaggaaggaaggactccagctgtttactaacaataaaaaagattaaacatcaaggaaaatgcttagcagaaaatgtacaaaatctatgtgaaaaaaaaccaaaacttttaagcatcactaaagacaacaaaaagaagacctaaataaatggaaaagcttatcatgttcaggggcaggaggactaaatatctaaaagatatcggttctccctaaaataggctaccagtttaacgtaatcccaggaaaaattccaagaggaacttttaagaaccagattcttggccaggcgtggtggctcatgcctgtaatcccagcacttcggaaggccgaagtgggcagatcacgaggtcaagagatagagaccatcctggccaacatggtgaaaccccgtctctactaaaaatacaaaaattagctgagcgtgatggcacgcatctgtagtcccagctgctcaggaggctgaggcaggagaatcgcttgaacctgggaggcagaggttgcagtgagctgagatcgcgccactgcactcccgcctggcaacagtgagactccgc

SEQ ID NO: 40456 - DNA, 428 bp, Homo sapiens
acgctgtcgaacaaatgaatattcctgcaaaagaatttagcatcctggaactcagttttcatggatgtcacaaaaatggtggtcttgaataattcctttgtctcagatataaatttctaagccaattggtgtaactttaactgggttgcacaaattaacatcagctctgtgaaattagaaattaatacagaagtgcagacaactctctaaaatagctcatgtttccattggaagtaacatctagatatccctgtctttctcctctcatttaaccagcacttactctgtgccagatatcatgctaatcattggacatatatttttctcaatgaatcctcacaatgaccttgtgagaaagagattattgtgttcattttgtaggtgaggaagaagattcaaaggatttaagcaaattcctcagaaagaga

SEQ ID NO: 40457 - DNA, 623 bp, Homo sapiens
taggtcacatattatttgatttcatttaggtgaattagccagaataggcaaatccatacagacagagagcagattagtggtttccagaggctgaaggaagagaagatggagagtgactgcttaggaatgcgatggggtctccaatgtgggtgctaaaaatgtttttgacctagatagaagaaacagttatacaatcaatactgtgaatacactaaaaaccattaaatgtacagtttaaaggggtaaatttatggcatttgaattacatctcaataaagctattttttaagccaacattaaaacttggaaaatttcacaaaaaattccagattgacttatcttgaaaaaatcctaagtaaaatctgacaccaccagccacagcattcctcataggaacatgagttggagatgaagctggtcctggaacccatctctgccaccacctaactctggacgttggcaggataattttttcatctgtacctcagttagctcctcttttctttggagggtaggccaaaaatcctgatcaatttaccaatggatcttcatctgctgcaattgtgaaagctcgttcgtcttaattctgttcagatctgggttcaaaatgagacacgatcctg

SEQ ID NO: 40458 - DNA, 609 bp, Homo sapiens
agaacacaatcctcaaaacgcaatgataacaaggaggggtgtctctagaatagggaactggctggagcagattcctaaaccatctctctccccttcaagctgccaaaggtctagtctctagaggaggtaaactgaggttccctggactgggagaaaccacgctcagttgtgaagaaaggtactgtacagaaaactgaggatttaagtgacgatatacatagtaaatgctgtgtgcacaataaatgaagctttcttccaccactcagccaccagaataccaccagcaagacctccatgcttcaagcaggacacaggaaaaggcctttccatgccatcgctcctctagagcttactctcgaggacagacctcaagatactgacaagagggatttcccccaataaaagagacaatgaaaatcatccaatggttaagtcaaaattgataaggcccacccacttgctcagagcttccaactggctacagagtaccacgatgttaatgagaagcagaaaattaagaattaataaacatctgaggaagaaataaaaaaaaaaaagaataggaagcagcaacttagaagaaacagaccatgcacagaggagaaaaaa

SEQ ID NO: 40459 - DNA, 317 bp, Homo sapiens
ctctaatcaagacaaaggtaatgatggatatatactacagtacatagggctgggcatggtggctcatgcctataatcccaacactttgggaagccaacgtgggaggattgcttaagctaggagtttgagaccatcctgagcaacatagggagaccctgtctctatacaatataaaaaaattacccaggtgtggtggctgctcaccacactagccccaacttttttaaagcaatgaacatatattaattttactacaatataagaaaacacggccgggcgcagtggctcatgcctgtaatcccagcactttgggaggc

SEQ ID NO: 40460 - DNA, 421 bp, Homo sapiens
catgtctttattttttagcatggggcttaacatttttcctactctgagttatcccagatcaataataatttctatatattataaacccttatttgccaaaaggtactagtactatgtgctagtaccttcctttccatttcattggtttttttttctcatagtctgtcatgcttgtttcctgacttttcttgctaccatagtctttatcttgcttttattcatagagttgactgctttctatttgatatgttccaactgccatttttttcttctcacccttgatccaaatttgatttctaattatataagataaacaagaatgccaaacttactgccctttgactaattagaacatggaaataatttgagttttagagaataataaagtttttttcttccatttacaaaagtaagaaaactt

SEQ ID NO: 40461 - DNA, 404 bp, Homo sapiens
gagagatttggatcttctgtcaagccaatgatttcttactaattgtgatcttgtgaaagtacttttccacacctcagtttcttctgtagaatgagcataatactcacattgcagataatctatagaataactaataaaaacaaaccttgtagtgtgcctgtcagaggtactcaataaatgttagttcccttttccctttgataaaatctgacctcatggagatgggagagaataatcttgcaatgagaataatttttacctcttgacttatgcatttttctacttaaattggatgtctgtctaatgcttattatatataaacatgtgtaatatagctgcacctggttttgtctagtgttgatctttggatttgatccagacttatactgtaacatttttatgcc

SEQ ID NO: 40462 - DNA, 375 bp, Homo sapiens
tcacaagctctctgaaggagctgactgtgaaggcaaggactgtgtctatgccttttttaaggagacgcacagtttgtcttaaccaagtggacacatgagaggcacagagaggggtgcacctcagtctacccaaggatatggagtgggggctttatggagacctgaggggcccaggcacagaaaagagacaaagtgagggaacacttgaggcagatggcagggcacatgcttagggaggaaagcttggaaaggcacaggcagagtgtttaaggatgtgcccagcatgtaatctagagaaagcagtcagaggaaatgagactggagaggcagctcgaggcagggcatatatgtgaaagtcactcgcaccccctctta

SEQ ID NO: 40463 - DNA, 323 bp, Homo sapiens
ttacatgtttcattcagttcccttatgagctcttaaactctgtatcatctactcaagaacaatgacatgttttgagcacttttatgtgtcaagtactggggaaacagattggacatgatctctactctcagaatttcacagactagaaggagacaagttcaatgagatgtgttaagttctgttgcaatattatagtattataagaatattacaagtatataatagagacagaaaagtagtagttggggagtaattagcatgaccatataatttatcacttgagaatagaaatgggtgctcttaaaaagggtgctgcaacaata

SEQ ID NO: 40464 - DNA, 593 bp, Homo sapiens
gtagcacttttttgttttccacaaacaaagatattatctttaaaatcaatgtacaattaatttatcatttctacagtaaagtcatgttttatatcattgttttgagtttaaatacatagaatttaaacaatagaacagtctatggccattgtgaggtttctctactcagcaacagaacatgctgaagagaaagcggattgaaatatccgacataaaattcaagctatggaacaacgatactaaattacctgatagaaaaatcacctcacacaaaaatcatctactaatttggggaaaaggagtggtgaaaaaagcatttaaatatctttccattagattaaaagattactgtctcctatccaatattgtaggaggaaataaaatcctagatatttaggaaaaggatctgaacatgctaaaaacaagtggtctgcatttacaagtgtgatggtgattgatctgagaggatgatctgaagatgttttaatgtagttgtgaatatgttcgcatagaagaatgctaaaaactattgaattatattgaattttgtcataatttataggctattaaatcatatttatacaaaaaagata

SEQ ID NO: 40465 - DNA, 509 bp, Homo sapiens
tcctctggctggtcgtggtggctcacacctgtaatcccagcactttaggaggccgaggcgggcggatcacctgaggtcaggagttcgagaccagcctggccaacatggtgaaaccccatctctactgaaaatacaaaaattagccaggtgtggtggcaggtacctgcaatcccagctactcaggaggctgaggcaggagagtcacttgaacgtgggaggcggaggttgcagtgagctgagatagggccattgctctccagcctgggggataagagcaagacttcgtctcaaaaaaaaaaaaggaaaaaagcaaaagaaagtgtcctctgaagcaacatagtgaaatatagtaaaacgtgctctgggcctgagaggctggaggtctagttctttgttacctttggtacactataactactctgaaccttattatctgtctttgcctaaaatgtatatagtgataactcttctgttcatctgacaggaatggtatgaagcactaaaaaaaa

SEQ ID NO: 40466 - DNA, 460 bp, Homo sapiens
  misc_feature (397)..(397): n is a, c, g, or t
aacccaggaggcagaggttgcagtgagctgagattgcaccactgcactccagcctgggtaacagagtgagactcttgtctcaaaaaaaaaaaaaaaaaaaaaatctaagatagaggtttggtcaacagtgctttaccatggaactgaaaccatgaaaagtgaaactgcaaatgggagagactgctgtatagtcactgaaaaattaatggatgagctcaacagcaaattagacacaactgaaaccttggacccatgtgtggaagatgacagcatcaccaactggagggtgcctggatccctgagtcaccacttgaagcaaaaaggtcaagagtagccacctgacccatatcaggctataatgaagagaaaatgacacgaggctttggaaccaagcaangtttccactgagtttcttctcatgttactgggtttgtaaatgaataaacacattttaactact

SEQ ID NO: 40467 - DNA, 742 bp, Homo sapiens
aggaggcgcggcagccgccagggcgaggcgacccggtgcggggggactcccatggagcgcggactcctaaggaagtcgctgggaatcccaccggctgtaccgcagggcgttagtacctagatggcttcggtgcccccaagcgatgggctcaagctacagggcgggctttgcacctggccttctcagctctgaggcaggcagtgggcagcttcgcctccaccctccgtccagcgcccttcccatggggccatccgcctctccctaaggcactaaaaaccagtggaggagtcaggccatgttggcaaaaagggctcgggcagcagccccagacctatagtcctaaatatccatgtacccagccctggggtcacgagccatctcagggacgacccgattccagcggatggagaagttccctgaaaacacctgcctgggaggagagacgagggaacgagattggacagtgctttaccatggaactgaaaccatgaaaagtgaaactgcaaatgggagagactgctgtatagtcactgaaaaattaatggatgagctcaacagcaaattagacacaactgaaaccttggacccatgtgtggaagatgacagcatcaccaactggagggtgcctggatccctgagtcaccacttgaagcaaaaaggtcaagagtagccacctgacccatatcaggctataatgaaatgagtaagaaagaaagattttgtgaggccacattttcataca

SEQ ID NO: 40468 - DNA, 912 bp, Homo sapiens
aggaggcgcggcagccgccagggcgaggcgacccggtgcggggggactcccatggagcgcggactcctaaggaagtcgctgggaatcccaccggctgtaccgcagggcgttagtacctagatggcttcggtgcccccaagcgatgggctcaagctacagggcgggctttgcacctggccttctcagctctgaggcaggcagtgggcagcttcgcctccaccctccgtccagcgcccttcccatggggccatccgcctctccctaaggcactaaaaaccagtggaggagtcaggccatgttggcaaaaagggctcgggcagcagccccagacctatagtcctaaatatccatgtacccagccctggggtcacgagccatctcagggacgacccgattccagcggatggagaagttccctgaaaacacctgcctgggaggagagacgagggaacgagattgggtaacagcttgcagcgtgataacaccatgcagtgtgagggagctgtatgcagtggagccgcaggggttagtcaggcctcgcccctaaatctgcctcttaaataagagtccgtttcagccaaacctgccttttccagttccgtggaggtcagtctgcacagccaatccctgacagtgctttaccatggaactgaaaccatgaaaagtgaaactgcaaatgggagagactgctgtatagtcactgaaaaattaatggatgagctcaacagcaaattagacacaactgaaaccttggacccatgtgtggaagatgacagcatcaccaactggagggtgcctggatccctgagtcaccacttgaagcaaaaaggtcaagagtagccacctgacccatatcaggctataatgaaatgagtaagaaagaaagattttgtgaggccacattttcataca

SEQ ID NO: 40469 - DNA, 446 bp, Homo sapiens
aggaggcgcggcagccgccagggcgaggcgacccggtgcggggggactcccatggagcgcggactcctaaggaagtcgctgggaatcccaccggctgtaccgcagggcgttagtacctagatggcttcggtgcccccaagcgatgggctcaagctacagggcgggctttgcacctggccttctcagctctgaggcaggcagtgggcagcttcgcctccaccctccgtccagcgcccttcccatggggccatccgcctctccctaaggcactaaaaaccagtggaggagtcaggccatgttggcaaaaagggctcgggcagcagccccagacctatagtcctaaatatccatgtacccaaggggattttatctgttcaatgtgcaacctgatgaagttttgtcccatgttaataatttcattaaaaatatggccttacatcctaaaa

SEQ ID NO: 40470 - DNA, 354 bp, Homo sapiens
tcccacactcaccattaataagactgctttacagaacttcacttgcttcttccacaagctactccaactctgatgttgctttttgagtccctgctctgttttaaatactgaattagacagctttgtgtacaactcaaagacagggaacaggttataatcttgtttgtatcacagtgatcccttatggtgcttatctcttggaaatccacttatgaccttcaataactggaccactgtccaaatgacattgctgagtgactgaaatgttcattttctgttatatagtctctctattcaagcctactgactgtggctatgtcatcacagttttgcttttgtgaacttttcattctt

SEQ ID NO: 40471 - DNA, 414 bp, Homo sapiens
tttttttctaagacaaggtttgcctctagcgcccaggatcgagtacactggcgcaatcttggctcacagcagcctacacctcccgggctcaggccatctttccacttcagcctcctgagtagctgggaccacagttgtgcaccaccatgtctggctactttttgtattttttgtagagagagagtttcactatgttgccccggcaggcccggaactcctgagttcaagcaatccacctgcctcgggcctcccaaagtgctgggattacagtcgtaagccaccacgcttgtccaataaatggattttaatggaggagttagaaaagttctttggtgtggtttcagattacacttcacaaccaaccttaaagaaactactactggatagtattaaagaagaatgtccacaattatc

SEQ ID NO: 40472 - DNA, 489 bp, Homo sapiens
ctccaaacagaagctttcaatggctttcctttgtaagtgcccagtggtgttacctggcatggaccctgcctaggtctaccatggttctcttcactgctaaccagcttcctgctacctggtctttcagtgccttgaagaggccaagctttttggggctccatacagctctcctccccaactgagacactcttcctcatgcttggcaagcgaattcttctcatctgccagtctcagcttccttgtagaaacattcctcgacccccaatctaaagcaggctactccctggggactaacctcaactggaaatagaattcttgtttgcctccttgctgactgctgccccctcggccagctctgggagggcacggatcatgtctcttttgttccccatcgagtccccagtgcctagcacagtgcctggctcttagcaagccctcaataaatattcatcaaacaaataagcaaatgatgaccattagaaaatatga

SEQ ID NO: 40473 - DNA, 227 bp, Homo sapiens
aaaatcttataccaagaagaaagctagaactgagctctgatcttcctggtggctgatgtaaaaaccaaaatataattaatcataggctcctcattgttcatagagaatatgtcaagacagatatgatttaatttttattatccataatgaaaaattctaataatcgtgaagagccctttttcatttagttgtttaggtataagtagactcagccttccatgttttga

SEQ ID NO: 40474 - DNA, 301 bp, Homo sapiens
gcatcaggtcagcgctcaaaaactttcagattttgaagcatttcggatttcagatgtttggattagggatgctcaacccgtattgatttaatatgcggtggaaacgtgacgacctaggttttaagtcgcggtttcctcagtggtgggtttggggtattacccctgcctggccggcctccgggcttgtttccagaagatgctaccccgagagctgcgaaccgccaagctccgcagcgcgcagggctccgacagggaccagcgaggtcagctccaagggtcaccccaggctccaaactggcca

SEQ ID NO: 40475 - DNA, 379 bp, Homo sapiens
aaatgcagactctcaggcccttccctaggcctattgtgttagagtcgcgtggtaacaagataccctgataattgtagagcactgacttttgagaaatgctaattagatggaggagagaattaggaaccaacacagaccagggctactgagatggcttcttccacaggtacctgtctccttttatctggcagctaatttgttttggccaagcttcagctaagagctatcccctgccctcactgagctcttatttaaggtgtttctgctagaaacttgagttcaggatgagctggagagagctgcctgtgttcaagagaaagatagtttttgtgtccatcttattgtgtattggtaccaaaggggtgatcagtgggatgaa

SEQ ID NO: 40476 - DNA, 570 bp, Homo sapiens
tcctactctgtcacccagctaattttttttgtatttttagtagaggcggggtttcaccatgttggccaggctgctcttgaactactgacctcaggtaatctgcccaccttggcctcccaaagtgctaggatgacaggcatgagccaccgtgcctggccaggcattatacttttaattctacttttgcaagggcctcaagtatcttaaaatacagtgcagcttgagtgcagaggaaagccctgtgctcgaccactccccgtactgctgaggaccagctgttgccagaccagttgtactggagataggcccccagggatttctgtccccactcctaaatcttccaccctgcaggatgccatcttctgtcaggcttctaaataaacggctctttcccttagagaccccggaagacaggcaccatattcagacagccaagaatcaaggtcagggaactctgtagtccaagaggcagagagacacccaagctcatggcacgtggaggccaaaagtgaaagaaactctggtccaacaaccccagaactggaatcgtccagtgagaggtgtgtacaa

SEQ ID NO: 40477 - DNA, 508 bp, Homo sapiens
gggccctatgaggagaaaggcagaatttctgcccctactaaaatcttaattaaaaataaaaaactaatataaatatgttaatattctaatatgtaaacgtaaaaatttaacattatgccaataaaagtaccaataagggccgggcacagtgactcatgcctgtaatcccagcactttgggaggctgaagtggggagatcacttgaagtcaggagttcgagaccagcctggccatcatggtgaaaccccatctatactaaaaatacaaaaattagctgggcatggtggtatgcgcctgtagtcccagctactcagcagacccaggcaagagaatggcttgaacctgggtggatggaagctgccgtgagctgagatcatgctactgcactccagcctgggtgatagaatgagactccgtctcaaaaaaaaaaatagtccagattctttcctaaggaaattatttttaaaaaccccaacaatttatgcttaaggaaattatctcagagtta

SEQ ID NO: 40478 - DNA, 592 bp, Homo sapiens
atacatgagatttgaattgctctttgccaaaacttagcatcactcatatattatctatcatatccccacagcattagaatccctagatagccaagtatggcatcacaacaggccaagcttctatctgatttctaagagaaaagtcattgttttagtgtatgtggacaagaaatggctctttgactgaactcactaatggtcttcagtcacaaaaaataaacagtggaaaattttctctgaagagaactccaggtagtagcctgttatcaaagaaaccagtgttagcttacttagaattatttgacttgatgtgtgggcagaaccacagttaaaaattgttaaggcctggtacagtagctcacaactgtaatcccagcactatgggaggctgaggcgggaagataacttaaggccaggattttgagtccaatgtgggcaacatagcaagaccctatctatctctacaaaaaaaaattaagttagctgggcacggtggcacgtggctgaagtctcagctacttgggaggctgaggcaggaagatcacttgatccctgttgagccatgattgtgccactgcactccagaatgatg

SEQ ID NO: 40479 - DNA, 462 bp, Homo sapiens
gcggccgcctactactactaaattagcggccgctgctacgccttgggcctcatactctgagttacactatgagctcctgctcccatttctcaggcctttaaactcagactgaattatagcaccagctttcctggttctccagcttgcagacatcatactgtagaacttctcatcctccgtaactgcatgagccaattctataataaatctcctaatgtatctctatatatatcctattgggtctgtttctctggagaactctaataatatactacctaatcaaattgttgcgaggattaaataaaatgatatatgtcatagtgccaaataacaagccctcaacaaatggccattatctttattactagtgggatttagatcatgtgcttcttactaaaataataaataatatttattgtttgtttcagctatgaaaagaaaacatttggaagatcactgatt

SEQ ID NO: 40480 - DNA, 474 bp, Homo sapiens
taccaccatgcccggctaatttttgtatttttagtagagatggggtttcactatgttgaccaggctagtcttgaactcctgacctcaggtgatccacccaccttggcctcccaaagtgctggaattacaggggtgagccaccgtgcccagccttattttcttgactcataggaataaatatgtctagtaggccctcgataaatacttactgaattaagattacagcaagttagagaaacttgatgtcttatttgttaaagggccaagtagaataaagactttaaaataagaaacttacataccatttttccccctacccttcccctcacataaatttggtcaacatacttcttagcctggcagagcggttcatgcctgtaatcccagcactttgggaaactgaggcaggaggactgcttgaagccaggagtttgagaccagcccagccaacatagcaagacctcatctctgcaa

SEQ ID NO: 40481 - DNA, 263 bp, Homo sapiens
actgaacaactttgttttgggtacttttatatataagagactcaaagttgtcagaaagagttctttactttaaaataagaaacttacataccatttttccccctacccttcccctcacataaatttggtcaacatacttcttagcctggcagagcggttcatgcctgtaatcccagcactttgggaaactgaggcaggaggactgcttgaagccaggagtttgagaccagcccagccaacatagcaagacctcatctctgcaa

SEQ ID NO: 40482 - DNA, 214 bp, Homo sapiens
gaagaaaaaggaagagatgacaaaagaacccggcagttcctaggagcccagccccgggcaagctctttctccatgtgttatttcatttaatcctgaaaacaacgttattaattcctatcattggtgctttacagatgagaaaaccacagctttgactgattaaatcatagcctttcttaacaccatgaattatactttgggaaatagtactcca

SEQ ID NO: 40483 - DNA, 491 bp, Homo sapiens
ctttttgaatcagatctggaaacttaagcttctcattggcatgaaatcagaagatgtgcacagcagattttcccattctgtgagatgagctggactgaggctcccaggaagtgagaatctggggcatttcacctctgctgtgtctccttcgagactacaatatcattcattcctgaggttcccattccctacatgtagtcattccttggtctgccccatttggaaaagggcactaggaatacctgtcctgccccattgtcatgagggtgttatggggatcccatacactctgaaaggtgcatgactgaattattggaatattgatgaagagtggaagtccttgtgtttgagattgtgtgtaaggagttcttcattccatgagggtgggggtttgtctggtttttcactgatatccccaaatattaggacaatgattgacgcatactgggcacttaaaaaaagtttattgaatgaatacatgtgaaaaaaaa

SEQ ID NO: 40484 - DNA, 291 bp, Homo sapiens
tgatgagctggaacagcagcaggtaggtaggtggtgggggccctctttttcacttttctttctctctttccttgtcgtgagctcaggggccataagccacccgttcaacagccaaaggatgaagcagatcttggcaatgttaccatttctgtaactactggaggcttgctgccctttgacagactggagtggagcgcttcaggggaaaagcagtacccaccaacaccgtggcatctctgctcaacgctgaccatcacgttgaatttctgtttatgtctgtagtaagataat

SEQ ID NO: 40485 - DNA, 260 bp, Homo sapiens
cccggctaatttttttgtatttttagtagagatggggtttcactgtgttagccaggatggtctcaatctcctgacctcgtgatccgcccgccttggcctcccaaagtgctgggattacaggcatgagccaccgtgcccagcccaggattctgtttctaaggaagagagcgataacagatattaggggcaactggcagacctgacctgactttttgccctgaatggttaattttccatctctgagggatgagtttcctttt

SEQ ID NO: 40486 - DNA, 531 bp, Homo sapiens
tacatcttgacaatccacaatagatggaagctatcattgattcattatctcaaaatggctccaccagccaaccccttctatccatccccagtgccacctcctaattcaggtccttgatgctttttgcttgcatggctgccagagctgttgggcaggtctctcagtgctgatgtcttcacccccactcctatctcctccatccaacattctaccaccaaggcaatcctcctaaaacacaaccacagtgttcttcatactccctatgattccctgcaacccacattattaatcattaatccaattaataaaaattaatgcactaattcccagctcctcagtgtggcccttcacaatctgcttgtccagcctcatctcttgcttccccagctttccccagcagacccctcttccacccattccaacgctgtcctcttctcccagcctagttctttcaggccctgtgcctttgcacttgcccctgtctgaaatgtccttcccacttcttcttgaagggggtgagtgcccactcac

SEQ ID NO: 40487 - DNA, 351 bp, Homo sapiens
ggctttcactggaatatcatattttaggatgatgcacataaaatcagataacatcagacagttttaaggaactgtcagaagcacttgaacaagagcaactccatcttgaataggggctgagtaaaatgaggctgagacctactgggctgcattctcagatggttaggcattctaagtcacagaatgagataggaggtcggcacaagacacaggtcataaagaccttcctgataaaaacaagttgcagtaaagaagccggccaaaactcaccaaaaccaagatggtgatgagagtggcctctgggtgtcctcactgctacactcccaccagcaccatgacagtttacagatg

SEQ ID NO: 40488 - DNA, 507 bp, Homo sapiens
ccgagccctgtgaggaaggggagcacagaacaaaggggaaaacagagccgttggttttccctctccgtctaaacatttgctaaatgggtcactgtactggtgaagtgtattcattcatctatagataatgcacatcctctttttaaaaaatttctttaattaatacactttatttttggagcagttttaggtttgccaaaaaatgagtggaaagaatgaagttcccttatgccctctcagctcacctgtcccccaccacctctgcacccccctcccgccaacagcttcctctcttattagcatcttgcatttctgtggtacatttgttatagtcgatgaaacaatgctaatacattaatattaactgaatccatagtatacattagggctcagtttttgtgctacacattctatgggttttgacaaacatataacggtattctcacccatcactactctattgtacaaaagaatttcactgtcctacaagttccctgtgctccactt

SEQ ID NO: 40489 - DNA, 394 bp, Homo sapiens
ggctctgccttcatggcctaatcaccttccaaagatgtcacctcataccatcactctgagggttagggtttcagcacatgcatttggggggccacaaacatccagtccataccagttgggtaaaataaaatatgttattaaagttaattgcatctgtttctttttaccttttaaaaatttaaatgtttgtggctcacattatatttctactgaacaatgctgctctagggtttataattaaacctgaaattgctaggcatgtacatgctgggcaaattttcagattgattattttcaacttccctcagtccctcccctttatttaacacccccacccccaaccctgccccaccctgtattccccagtacttggtgaactttcctctgtctgggc

SEQ ID NO: 40490 - DNA, 565 bp, Homo sapiens
agataaaacaagaaggcattcctgttataaaaagtgtaagcaatcctatgttttgaatattgaatgaaatgtggacatttccctcatgccgcacccaatcccactttcttacccagagggttacagctatctacttacgcagtagatgcttggcaatccctttgccccttccctccttgaggtgactaagatggtcatgcagacaagccacccctcccaacagaacccatgtgatctagggggaagctgaccccacccataatgggccaccatcagtctagggctgtgtttttttgacgtgtggaccttgaagccttcaggctcctcaagatgctttcagctggtccaagggaaaaatgttttcacagtgatactgagacatcatttgccttttcactattagatttacagtggtgatgcaaaagcaggggtaggtaaatccactagcacctcactgagagtaaggcaatgacacagaaagttacctactagtgaccatcatgttcttcatcacaatgtgatcatggcagaaaaacgcttaagaatagcctgatgtgatagcaaa

SEQ ID NO: 40491 - DNA, 355 bp, Homo sapiens
cccttgtccttctccttccatccctcatctaatagtctgttactttgtactgtttgctattataaattggggggaagccattattattatatattagcttcagaacaactagattcaagtcacaaaaacaatttcgcacaaacaactttaggaaacactgctttgaaaacagtaatctgaattatacctgaagccacagaagccaaatatttactaaaggttcttttaagaaaaacaagttggccgggcacggtggctcacgcctataatcccagcactttgggaggccagggtgggtggatcacgaggtcaggagattgagaccaccctggccaacatggtgaaaccctgtctc

SEQ ID NO: 40492 - DNA, 184 bp, Homo sapiens
ttttgttttttagtttatttgaggtcttcacatagaagagtatttatgtatgccaaaaaattcaaatctcaaaattttccctccaattcctgactgggtaggttgccaaataaaatgtaaaagcccagtcaaatttgaatttcagataaataacaaataagtttttaaaagttataagtatgtc

SEQ ID NO: 40493 - DNA, 315 bp, Homo sapiens
  misc_feature (211)..(213): n is a, c, g, or t
cccagaaacagcttttcctaggactgggcaatgtctggtgcaaaatcgaaagtctcacatggagacacaaggtcacgtgttagaaccttgagctggtctccacatgcctgcagactgagaggctggaaacaaggagtttcctaggtgttggtaattcacttgttgcctggtttagggctggggtgaccagacaacagaacgggcaaatacnnngcctgactcttggctctttctttcttttttttttcgagatggagttttgctcttgttgcccaggctaaagtgcagtggcgcgatcttggctcactgctacct

SEQ ID NO: 40494 - DNA, 1126 bp, Homo sapiens
catcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcaggtggatcacgaggtcaggagatggagaccatcctggctaacacggtgaaaccccgtctctactaaaaatacaaaaattagctgggcgtggtggtggtacctgtcatcccagctactcgggaggctgaggcgggagaatcacttgaacccgggaggcagaggttgcagtgagctgagatcacgccaccgcgctccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacagagtgaggagagtctccgtcgaactggggatcctcagagtcatcc

SEQ ID NO: 40495 - DNA, 1266 bp, Homo sapiens
catcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcaggtggatcacgaggtcaggagatggagaccatcctggctaacacggtgaaaccccgtctctactaaaaatacaaaaattagctgggcgtggtggtggtacctgtcatcccagctactcgggaggctgaggcgggagaatcacttgaacccgggaggcagaggttgcagtgagctgagatcacgccaccgcgctccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtct

SEQ ID NO: 40496 - DNA, 370 bp, Homo sapiens
gataaatggtgataagtacacaaattgctttattaacttaggcttatcagattaaattacaggcaaattttaccaatggccctctacaaaaagcatacatgaacaaagaagtcatgtaataaataaactctcagcagtgaagagccacaagtgacaaaaaagactaaaaaccacagagctacctgtctctgaattgggacatttatcaacaaaggttattcttgagaagtcagtatgagtttaaagcatcttcataaacgtatccagtgagccaagatgtagcttgacatgggtttaggcatatcactcccaatgatggaaaggaacagaaattttatcactaatattatggtgaacattggtaggatca

SEQ ID NO: 40497 - DNA, 343 bp, Homo sapiens
tgctggggagctatgcaaagcacgggtcgccgcgctggactgagcaatggaagatgtggctgccactaagagtacaggctctggagtcaaactgctagggtctgggaacccggccagtgccttctagcattgtgccctcgtttccttaacttaaaacggaaataactgcataaaggtgccaggagaattaaagagctagcacagaatcaagttacacagtgtctggcacatactagtatgattgcctcatccgtaggtggatttgacagtctgagtttctgactagatctgacttccattgtattaaatgcgtgtgcttttatgtataatgaccattatagtt

SEQ ID NO: 40498 - DNA, 493 bp, Homo sapiens
tctcgttttggaaatatattagcagctcaaaacagtttgtctaaacaattacatttctgcattttctgttaatgatccaggacaaagtaacatgacaactttggtttggtaggtaggatgggatgcactaagaaaatagattttctcagttttgctctgtcttctaagaagactgttgagtctgtcctcgtgaatactgaattccagagagccacgaagattaaccaattcattcctcctacctctttcttctccgtcctccagagattttcctaaataagatgtaataatttggcaacatttttctttccaatgtagcttcctgagagtttcttggcctatacccagctgaagtgcagggaagagtaagtgctagcacttaatgttccatccaacaaggagccatgttggagagtaacttcctgtgtcctttgttgccttacatgtggctttttccacaacaaattaaattaagaaaatactgaaaaaaaaa

SEQ ID NO: 40499 - DNA, 587 bp, Homo sapiens
tgtcttctggaatactattttttctttcacaaatcttagagaatccagggggcagaaattatttctgagttttcctctcaataccagcatctgattggctgaccagcaatgtacctctgagaaatggaagtcgggttgagtgaacacaatcttaatgcctcaaagggttagctttccaaaggaagggtataccaggagattcctctcagccccagggcatccacctgctcccttgagaggctacactccaacctcagattgtcctctgtctcccattcccagatacccagagttccattccaggccaggagctgaaatttactagagattctagcatacacagccacagttgatatcttgatttatccccagacagtactgaaacccaggaccaggagaaaaccgaaaggtggctgaggacacatcaccctgtaaagtttccaaagggaaaccttgacccaaaaacattctgataagatctctgcgcctagggaagataaaaggaaaataggcacagacttttttttacaatacagtgtcaggggattattttttgttttcttctcattggaaatattttcaaacag

SEQ ID NO: 40500 - DNA, 375 bp, Homo sapiens
gagtctacaatttaacattacattttgtcttaggttactgacttaataacccgatttttctggattcccctggcagcctgttttccccagtcatagcagaccacagggaaaagaaatgaaggggatactgagaatagacctgcagcaccaagaagacatggctgactgcaaggaaatgtgcctcacggagcagagcccaactatctgcagcagtgcggggccaatccaaagaaccccaggttcacttagagcccgagagcctcactgcatcctaataacaataaccaatgcccaccctgatgaccaagaccgcaagaaaggccaaagtcggccaggcacggtggctcatgcctgtaatcccagcactttaggagg

SEQ ID NO: 40501 - DNA, 571 bp, Homo sapiens
gggaatttcctcagtttgatagggcacttctacaaaactccagcaaacacttcctagtgaatgtctagatgcattcctcctgctaccaagtcaagtacaaggatgcccactctcattccttctgaacattttatggtagttctggccagcacagtagggcaaaaagaaaaaggcattgggaaagaagaattaaaacctgccagagacaacttgtagaaaatctgatagtatctacctaaaagctattaggattaatatgggcttggcatacaaggttaatatacaaaaatctattgtatttctatgtactagccatgtgcaaccaggaattgaaatttaaggaatacagtttataatgtccaaaattatcaaaatctaaggaataagtctgacaaaagatcaggaagacctgtgcaatacagtgagaacttcaaaaggttgctgagagaaatcaatgaagacttaagtgggatatatactgtgttcatggatcagaaactcagtgtactgaagatgtcagtttccccctaaaagatttagcccgcctgggcgacagtgagattctgtctcc

SEQ ID NO: 40502 - DNA, 341 bp, Homo sapiens
ttgtataagctttcttcttttcgagacttctcaaatttagagaacccaaatctcagtcctctgacgtcctctcaacctatactcattcctgggtgctttcattcagttctgtgattttaaacgctatctttactcataagcctccaaaaattatacttctagctctagcctcttcattatattccaggtagttatatccagttggcaagaccagctacttaatttgttctccccatcctccaccccccaggacaacgttggggggcagatttaacaattattaaaaatgttaagatgttgacagcaaagcatagggcccttctgagtatgggctctgtgag

SEQ ID NO: 40503 - DNA, 321 bp, Homo sapiens
gtaggtaatttatcatactatatgcaatagaaaatttaatgcctaaatttaaatcctgaagcaaaactgatcatgtactactgatattttgactgcactccctatctttaaataggttgaagtttacattataaatttcagacaaattctggcaaaatgaggaagctctcctcatgactgatcttctggtctctctaaatccaatcacatttcctgaagcacagctcagctcacactatgctgaccagactcttgtaactgccagctgctgtaaaaattcacagcagcttcctgcataagttattcacagctccatgaacc

SEQ ID NO: 40504 - DNA, 410 bp, Homo sapiens
acgggccccctttttaacccgcgtcctcgactcccgcaatgaggcgccgcagcccgagagcagaataggcttgggcctggcggggagacgctgaagcggagttgccgggcgagagaggcgggctcctgctttccccttcctccccaccccctaggacttccaggtggggaacctagggctgggtgccggtttgtcctgttcaggcagagtggcggccgaccccggtcctgggctccccgctgtccccagccgccgcgcactttgggctgacaggcagcgggtcaagtcctcgtaaggacacaagatccagatgactcccagaatcggcctaaacgaagagctcattgtctttttgttttccagaaatgttttttgggtgcctgcaggggatttgggcgccggagatgggg

SEQ ID NO: 40505 - DNA, 360 bp, Homo sapiens
ctgcctaggcaattgggaggctggaaattagacattgtatctcatgcctgattcttccgctcacaaaggcaggtccccgacttgggtctccaccaactctccactgcaatgattgggatgatgatgtgtgcagtgatcaatgcaaaagaaagtaacaggaaaatctttcctctgttccaccctttctttttccttttatgaatgagatggtggagaaagagctaagcagtctcatacctcaatattcaacaggccaaggggactactacaaaagatgtttccattctactcacttccacccttcctccagcagggagaggcaacaagatagctgcactgaggaggttttatatagggagg

SEQ ID NO: 40506 - DNA, 196 bp, Homo sapiens
aatttggacacagagaccaacatgccagaggaaagaccatgtgaaaaggcagggagaagacagccattcacaagccctggacagaggcctggaacagattctccctcacaccctcacaaggaaccagccctgcccaccttggtcttggacttccaacctccagaactgtgaggcaatacatttcgctgtttaagcc

SEQ ID NO: 40507 - DNA, 542 bp, Homo sapiens
gaagagcaacattttcagtatttagaatagacttatgccagactacctgggtacagagcctggcttcatctccttttacctctgtaaccttgggcaagatacttaccctgtctgtctgttttggtttcctcattgatctaatcaaattataaataggcataggctttccagatgtttttatggttaaacaagttgatattgataaaacatttagaatagtactggaacataaaaaagactatataaatgttaattgttatgagaaatatccttttcatgatgatcattaccaccaccatcaccaccatccacttctgctgcacagagatgcaatccaatgtttccattcttctaaagtataattattttgaaataagtggtattattttaaaaatagtgaagctctgtaataagcttcactgtttagaatatgaaataaatggtaacatacatgtgaataatgtgcatttgtattatggaatatataacctaactcagaaccttcaattcgaagacttagccacctatcacaccccatccta

SEQ ID NO: 40508 - DNA, 393 bp, Homo sapiens
gctcttcctttgcttttttttaaattaagaaactattttttttagagcagttttagattcacagcaaaattgagtgaaaagtgcagaggattctcatatacctcctgtcctcacacacactagcctcccccactgtcaacatactgaaccacaatgctaatttgttacattcaatgaacctgcattgacatattatcacccaagtccatagtttatattagaattcactcttggtattacaaattctgtaggttttaacaaatatataatgaggccgggcacagtggttcatgcctgtaatctcaacactttgggaagccgaggcaggaggattgctggagcccaggagttcaagaccagcctaggcaacatagtgagaccccatccttacaa

SEQ ID NO: 40509 - DNA, 644 bp, Homo sapiens
ttttaacctttttaaaaggtatttagcagcttacatatcatctactaagagcaagaaatagtagcttttgttgttattatcataatgggcaacgtgaggtggagggaggcgggagatgaaattcttggttgaaacaatagtcagaagaaaataatcttctcatttttcctcactttagttgattcattcattcaacaaacctttgttgagtacctaccttgtgccaggttgtcttgtgctaggtattggaagggggacaagggagatggaggtaagacagatgaacacaacacagtctttgctgaaggaggtcatcccttgtaccctgggcttcagttagcagtttagccctttgcccatacagtaaatattcattgctgtcctacttcaagccagtctcaagggatatagaattgaatcagactgtatttctttcctcaggaaacatatagagtactgggggaaacatcaatttgaggacagtgtgatcaatggtgtaattaaggtagatacaaaatactgaagaaattttcaaggaactgcaaatcaacaacaggaaaaataaaaaacaatgacaagaaacccaatggaaatgtggctaagtacttatgatacccaatgcaatgaaaaaagtaaaaaaaaaa

SEQ ID NO: 40510 - DNA, 920 bp, Homo sapiens
tgaaactcctatggggctaaggagatcaattttataccaataaatcatttcagaaaatgaggtcattttaatattcttggggttactcagcaaaacactttgcttggacgtctcttttgtactttccttaaattcttcttccttttcttctcggctttttgaatgtatgactgaagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaa

SEQ ID NO: 40511 - DNA, 1402 bp, Homo sapiens
atcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctctttttttaaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacgtgccactgagcatgcttgcagggaggaacttggattgtccttcagtaaaattccactttgatgcgcaaagcgaacttgaatttctgcttggcctaccacaggcctgcaacatgcactttctcctcgagggaactgccactcactgacacggacaacagtaaaggaacttggtcttcactatgcctcatagtggtgggtcacactgcccaggaggaacccgcaatgagaccggcaaatgccttaaccatctcattgtctcatcaggaagaagcttaaatgactcttcttgctcacatacttcctgggcaaacatgtctgctctgttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaa

SEQ ID NO: 40512 - DNA, 703 bp, Homo sapiens
atcaaagcattgatgagtgtttctgtttaaattcaaaggacattccacctttaaccttagcattcatgagacacaaaatgggtttttctttttgctgatttaaaaagctgctatgaagctgcacagtgcggaagagggcacccctgctccagaaaagaagaaacaaaactgcctgccatagacacttggtagggagtggcaaatggaatcttggtttgtttttctcttaggactttgacaattatttttccttgaaaagaataagagaatctacctaaaatattaatactagtttcagagctctaggataatatagagcagagtctctttttttaaaaaaaggaaagcggtttcatttctgacagtggatttcttccactgatgtgcacactctttgacatgaaaagctgcacgaagctgccttgaattcattctgcagatggaaagttgcaagtacggtaattagctaagcagtggcaaggccgaccatctgaggtttgatttctcatcaagagatagtgtccgacacgtgccactgagcatgcttgtaagagttccacgtttcagatgcactgagaatgcatgcatggaacacacgtccccccagcccaacaaccgcactcccaaattgcccctgcacacatatattctaacacggttacaacacagcatgctcccgagcctcagacaataagctgcccaa

SEQ ID NO: 40513 - DNA, 440 bp, Homo sapiens
cagagtgaaccaactgttatctgtaattcaacagataattaactgaaactcagtgctcaaattgctactgggagtttctgcagccaaggtcattctcatggtgctgcttgattttgtttctgtgtctcttatatcgttttaggcagggaggaacttggattgtccttcagtaaaattccactttgatgcgcaaagcgaacttgaatttctgcttggcctaccacaggcctgcaacatgcactttctcctcgaggtgagaaggtctttttctctccactctgaaacaccgctgcctgcaccttttgctgagtttagagtagcatcatactttctgccacgaatgccacaaatactgccttttcaacttggttttgtaaaatgtaatggtactaaatccgccaaagggataaagcacccttactttggatttgccagtccca

SEQ ID NO: 40514 - DNA, 582 bp, Homo sapiens
ttgggataaaggacgctctagaccaggctctgctgaaagatccagggcaaaggttcctgacaagactatgtccagcctcaaataaggccacagaagagcccaggctcgctgacgagcaccggctccgaggcagtcacatcaggagacagaaacagacatgttggtgctgccctctcaggtcagtgcaaatgccacttgaggagggctgagagctttgcagcataaaatgaccagaacaaggagaaacacagatgcaatggcaatagctggcaattcgcacatggcgtcaaacaccactgccacagaagctttttagctacaagccacgctatgcaacctttaagcaaaacattattgattttgtggttgtaaaaacataccttcaactgcagaactcagttttatgacaccttgaataaaaacaaaaagtggcagttatataatggacccaaatcgccttttccaggcttctcataacacacgcatgcttcagatttggatttttctttttctgctggcattgcaagaacgtaactaaacaaatatcaacttcaaaaataaaataatttttagtcttaacta

SEQ ID NO: 40515 - DNA, 658 bp, Homo sapiens
tgtccggtgccgtgagttacctgctcagccctggagcaggggtcaaagctgggcggagctggacagccagtctcagcctcaggtactccagtgacaagcagcagcaccagtgctgatgagggtagcagggaaaactggtgaaatgtgccgaggtctctccagaggtggtaggcggttgcgccagcttcacatcctggataggcaggaacgtttccctatcatactcctgtcccgggtctcatgtgtctcagttcaaacagacactgccgtctatcttcaagctgcaatgaagctgagagccacagaaaacacctgtaccatggtttcagggaggagtctcttccctcagccgaaaacagacagctttgctggtcatctgttctccactgcgaggacgctgccactcagtgtggagagaggaaggggttctgcctatggtgcaagaaggtcggactcggcagttaatactcttggataatgtatttaaggatgcttaagaaattgcaacagccagttcaaccttcagcaaccaccatactgatcagtagtcatcaacattgagacgagactgtacaccagcaaaaagatcccaactcaatgaaggctcagatgattttagcatttttttagcaataaagcatttttaaattaaactata

SEQ ID NO: 40516 - DNA, 700 bp, Homo sapiens
attctgaaagcatctctgccaactctagagagtttagatatctacttatttatatctacatctatctatatttatattaaacaaaagtgacaggacatggtaatagatgcaatgtataggtgaattagagagaggtatcaagcttgactcccaggtttctgatagaatggctgaattgatggcaatacctttcactgagaggaaacattggcagaaaaccagttttgaatgaagaggatgcttccttttccttctgacatgagtggaaccagccataggccctcatcagaggcagatgctggcactttgcttctcgtacagcctgcagaatgttaatactcttggataatgtatttaaggatgcttaagttcatcatgggtcctctggaaatctcctacctttgtgagcaaagattactgcagggtggaagacaggtccatgattgcccaggctgcagtgcaagaagtatgatggcaccatatctcatcttgcacctcaatgatcatctaagcaagaatccttctgcaagatcccatctaaaattacatttccaggcattccacataaccggagggaaaaaaaaacatggatcctatgggaaagtattgaagagtttcaaaaataagaagaaaaatagcagaacagtatgagaagacagatggctcagctgatgacaaaatccatttgacttttaccaca

SEQ ID NO: 40517 - DNA, 886 bp, Homo sapiens
tgtccggtgccgtgagttacctgctcagccctggagcaggggtcaaagctgggcggagctggacagccagtctcagcctcaggtactccagtgacaagcagcagcaccagtgctgatgagggtagcagggaaaactggtgaaatgtgccgaggtctctccagaggtggtaggcggttgcgccagcttcacatcctggataggcaggaacgtttccctatcatactcctgtcccgggtctcatgtgtctcagttcaaacagacactgccgtctatcttcaagctgcaatgaagctgagagccacagaaaacacctgtaccatggtttcagggaggagtctcttccctcagccgaaaacagacagctttgctggtcatctgttctccactgcgaggacgctgccactcagtgtggagagaggaaggggttctgcctatggtgcaagaaggtcggactcggcagttaatactcttggataatgtatttaaggatgcttaagaaattgcaacagccagttcaaccttcagcaaccaccatactgatcagtagtcatcaacattgagacgagactgtacaccagcaaaaagatcccaactcaatgaaggctcagatgattttagcatttttttagcaataaagcatttttaaattaaactatatacattgttgttttagacaagtttttgcacattcagaatacagtaaagtgtaaacatgacttttatatacactggggaaaccaaaaaatttgtgtgacttactttattgcaatatttgttttattgtgctgatctggagctaaatatatctgagatatgcttgtactgatgattattttaacaccaagatattttaaaattcattaaataaatgtttatttaaataga

SEQ ID NO: 40518 - DNA, 292 bp, Homo sapiens
aaaaaaaattctgcagaaaaaattaggcataatatacaaatctagtttggaaatacatttatcaggttctcaaatgtgtccttttgaataatctatacaaagaaactcaaaattttctcacccatacattttcttcttagcaataggtgcacataagcatatgctaatttatttatttagcctattcagggatgtgctgagagaaggcagatttcacattatttatcagagggtaacaattcttgcagagaggtgtctgctggggcgtgcagtatggtaccggtggcctttg

SEQ ID NO: 40519 - DNA, 218 bp, Homo sapiens
ctggcttctgcagctggagttaaacatgatttgctctttgctttcttaggcttttgttactgaattattttatgttatcttttagatgttgatggtcacttgcacgtgccatagcggaggtctaatggtctcaaggaggattttaactttgtattttgggtaatgtctttgtgttttccttcttctgatacattctgctttttaaatctatttaaact

SEQ ID NO: 40520 - DNA, 324 bp, Homo sapiens
cgtctgttaaaaatgtggaaagctagatccgtatattttcctttgcctcttttatcatcacatgatcccatataactttggggaggattttagaatattatttggcctttggtttttggtttttatttctcttactgttgttttatagggactagagtcttgtctggagcatactaacttttatttatggaaacatttctggcctatctttacctcccatagttcccttatgtataaatggagaatctgcagagttgatttcagttccatcatgttgatattcctctcattcaggacatctgtaaacacaaataagaattgctc

SEQ ID NO: 40521 - DNA, 974 bp, Homo sapiens
caaaaattcttcctaaagagagggaaccaaagtcacatgggtcaccttgtccacctgtgtggacgttgctcatgttcacatacccttccttgcctccttcaaggcaggtctggccacaagcccagctctggctaatgaaatgtgaagggagtcaagggccgggggcggtggctcacacctgtaatcccagcattttgggaggccgaggtgggttgattacctgaggtgaagaatttgagaccagcctggccaacatggtgaaacccgtctctactaaaaatacaaaaattagccgggtgtggtggcgtgctcataatcccagctactcaggaggctgaggcaggagaatcgcttgaacccgggaggtggaggttgcagtgaactgagattgggccactacactccagcctggatgacagagcaggactccgtctcaaaaaagaaaaaagaaatgtgaaggggtcagttttggggcaaaatatgtcattgccagtgctcaattttccagccctctcttcctctgccatgaccgttggggaagtacatgttgagatggaggtgctaaatagttgagtcataatctcacctggatacgctgtaacaaatgccctggattatcaaatcagttatgtaaactaaaaatcctaaaaccccaccgactgaacagatgccacctcgtggccgagggaatctcagaaaaaacttaaaacaattcctggccctgatgggttgggaggtcagatgcaacttgttataccccatccctttatggtttagacacagctgccgagcatgaatgaacaaaatagggatcatgagatggacagaacagacactgtggcaataagataccaaattgtaaacaggacctaaggccatgccaagcaagggttaagtcatgtagagcccgccttcatgccccgcctcccctgcccccaacttatgaataaactatgttctaactgcaaaatggg

SEQ ID NO: 40522 - DNA, 387 bp, Homo sapiens
  misc_feature (357)..(357): n is a, c, g, or t
  misc_feature (361)..(361): n is a, c, g, or t
caaaaattcttcctaaagagagggaaccaaagtcacatgggtcaccttgtccacctgtgtggacgttgctcatgttcacatacccttccttgcctccttcaaggcaggtctggccacaagcccagctctggctaatgaaatgtgaagggagtcaagggccgggggcggtggctcacacctgtaatcccagcattttgggaggccgaggtgggttgattacctgaggtgaagaatttgagaccagcctggccaacatggtgaaacccgtctctactaaaaatacaaaaattagccgggtgtggtggtgggcacctgtggtctcagctccggggtggctgggactacaggtgcatgccnccanccctggctaatttgtaaaattttttg

SEQ ID NO: 40523 - DNA, 311 bp, Homo sapiens
ctgaggtttagagaggtgaagtcatttggtcagggttacacaggtagcaagtagaagagttatgtttagaacttggctccaaagccttagttctttttattctgctaactagagcttcatagaaattaatttccgtaaagaaatgacatagaatggtagcttcaggcaaccaggtaccatgctggggagttgacttgtacatctcatttcattttcataactaccctgcagctgtcatcccatccccgttttacagttgagggacctggggctccgagaagggagatctgagcatggcccacagctggtat

SEQ ID NO: 40524 - DNA, 443 bp, Homo sapiens
accctcagaagactgacatgcaagtggggaagaggccgctcagcggccacctcctagaggaatatcagctgtgcaagggcagatgggtgacactgacagtccagtgacagccaaagagaggagcagctggagagaccaagaaggtggcgcagggaagctgaggggccatcctcgacaatcacaaagccgccctacttcagcctttcctatgtgactctagacaagggccaggggaagtcctgggatgccgcagtgcatccacagctggagctgtccagagcaggaggggccagccctgccccggcaggagtgctgcagggagatgtcctgctgcataaactggtgacctgtgacatccccaggctcccaggttctaaaattccgtggtgtgccttgaaaagtgaccattgtttttggtcacaaagtgattgttggggctcttt

SEQ ID NO: 40525 - DNA, 385 bp, Homo sapiens
gcgggctacagctggggctgcggtcagcgcttcgatcatgagaccaattccgatgatgcctgtacataccacccaggtgttccagtctttcacgatgctttaaagggttggtcttgctataagagaagaacaactgatttttctgatttcttaagcattgtacactgcacaaaaggtagacataatagtgagaagccacctgaaccagtcaaacctgaagtcaagactactgagaagaaggaaatatctgaattgaaacccaaatttcaggaacacatcattcaagcccctaagccagtagaagcaataaaacggccaagcccagatgaaccaatgacaaatttggaattaaaaatatctgcctccccaaaacaagcacttgata

SEQ ID NO: 40526 - DNA, 884 bp, Homo sapiens
tttattctatattttggaacaaatcttcacaaaattcatggtatgcacgccggccccttcctagcgtgtaggtgtgcactttgaccctgctgtagtgtgtaagtatgctcactgacctctgccctactgtatatcctgacacaggaagggggatgtcttttagaagctcatttctacctctttcccagctcaactgtgcttgtcttgactgtatcttaaaagtgctggttaatggtgggtgtctggacaaggtaggagagtctataaacctataccgaagtcctctcttatacacggttttgctttccatagtttcggttacttgcagtcaaccgtggtccaaaaatatgcgatggaaaattccagaaataaatccttcataagttttaaattgtgcaccattctgagtagtgggatgaaatgcgtcgttctgatccattgcctcctgcatgcgaatcctcctttgcccggagtccccacctgcccatcacttagtagccaactcagttctcagatcagctgtctatgtggccgtgcttatgttcaagtcacttttatttaataatggccctgaagcagaagaggcatgatgctggctggtaatttgtatatgctgaagagaagctaccaagtgcttcctttaagtgaaaagatgtgaaagttctgaacttggagaagaaaaaaaaatcaaatgctgaggtcgctgagacctactgtaagaacaaatcatcttctgtctgtgaaggtgtgaagaaggaaaaagaaatttatattagttttgctgtcacacttcatacgttcaagttatgaccactgtgtgacaagtgcttagggacatttgtaggtagaagacatgaacacgagctccgattgctggcagacgg

SEQ ID NO: 40527 - DNA, 422 bp, Homo sapiens
acaggcagatgcataggtgaaaactgcaggcaggagaggagttgaagtgtagaaatacagagctgtgaatggtcacacatattagtagttgacagtatcagtaaatgagaaaagagagaaccaggaaaaatacgtagaatgtaggaaagggggaatggagtgagagggaagaccagagggcttgcagggaaacaagggcagcaatagtgacacagaagcaagggaggggagagttctagaaacaaggatctgatcagacacggcctcctcaccagatcaacccaagcaaggttgtgtccagaaatgcataagatttgagaacttctctaggacctcaggcccaggtctcaaagaggatcccctggggcacactaggaacctcccaccagtcttcctggaagccgccctgatagcaatggcca

SEQ ID NO: 40528 - DNA, 383 bp, Homo sapiens
tgagccaccacacccggctactaaaattacaaaaattagctaggcatgggcatggtggtgcatgcctgtagtcccagctactcgggaggctgagacaggagaatcacttgaacccaggaggtggaggttgcagtgagccgagatcacgtcactgcactccagcttgggcaacagagtgagactttgtctcaaaaaaaaaaagaaaaaaaaagaggatccttgctccccacaacgccacccctcctctcctctcaattagatgatgtctataaagccccctggagccagaagcactataaatccaagacattactgttagatccaggtcggggaagcttcaaggaggtgagcatgggggaggggtggaaggtacgcggtcggtt

SEQ ID NO: 40529 - DNA, 453 bp, Homo sapiens
gaacacattgtgatttacccagttatatcaggctgtcttacaaataacctaaaaattaatatgatcaacaagtatcttaccacatcacagaatcctacccatcccactcccactacctgactactttcaaactcgacgtctttggttcttggattcttgaattcatagccagaatttctcactggtaagagttcactccagtaacacgagaacaagaacaggaaacacaatcaaggaatgattccaaagatcaggaggaaatggttagtacaacagtaatctttcttaagaattttccagtaacactagttttgcctgtcaggagagcaaagaattaaacatcttaaaatcaactctcaagacacttaacatccattttatacacaaggaagacttcaaccagctacaagtgtataatttaaaaattcagcttattcagcagagtgaatatgg

SEQ ID NO: 40530 - DNA, 349 bp, Homo sapiens
gttttgtgcctgaaacccagggcccttttggtgtatgcacacagggaatctcctggtctgtgaattgcaaaaatcatgggaaaagcatagtacctgcgctggatagcacagtccctcactcggctgcggaagggaggcccccaactccttgcacttcctgggtgaggcgatgccccaccctgcttctgctagccctccatgggctgcacccactacctaatctgtcctctcagttggaaatgcagaaatcacccatcttctgtgttggtctcgctggaagctgccagacggggctgttattcagccatcttcaagtcttgctttcaaatgtttgaagtataaacctaga

SEQ ID NO: 40531 - DNA, 274 bp, Homo sapiens
ttcaaggtgtcataatgcccttaaggtttatccacgttatagcatctgacaggatttccttcattttctatttgtttcttcttatataagagtattcaacctttaagtgcatgacaaagtttatacccattcctgttctagaatagtcttacaggctgggctctgtggctcatgcctgtaatcccgtcactttgggaggccaaagtgggaggatcgcttgagcccaggagttcaagaccaggccgggcaacataagtgagatcatgtctctaca

SEQ ID NO: 40532 - DNA, 875 bp, Homo sapiens
cgggtacgtgtacatgagcacactcgggtacgtgtacatgaggacagttgggtacgtgtacgtgggcacactcgggttcacgtacagggacacacacattctcgggtgtgtgtacctgggtggcagtgtgtgcatggatgtttgtttacatgagcatcacatgtgtgtttacgtaggtgcccgcgtgtcggcgtctatgttggtgaaattgtagaatgtgtccaccaggagagagcagtcccctctgggaatggcgggggtggagggcacaagagactaggcttaaactcatacttttaagtttgtataaaggagactgcattctggtaacacttgtgtaactgaaatgcaacaacgacaaacataatcaacagcttcactgctaccagggaggggccggccaggcttgcctagtgagcacagctgtgagagaccagggcggggggcatctgactcggaggctgggtgctgggagatgggggttctgtgcttgtctgtccccctgatctgtaacacgacctgtgactcttagggttaaaacgataaaaagggacttaggaatttggctggtgaagcgtgcgagacccacagctctccaacctactaaaacctaggagggcggccggccgcggctcacgcctgaaatcccagcactgcgggaggccgaggcgggcggatcacgaggtcagcagatcgagaccatcctggccaacacggtgaaaccccatctctactaaaaatacaaaaaattagccgggcgtggtggcgggcgcctgtagtcccagctactcgggaggccgaggagggcggatcacgaggtcaggagatcgagaccatcctggctaacacggtgaaaccccgtctctactaaaaat

SEQ ID NO: 40533 - DNA, 298 bp, Homo sapiens
tcaatttgatcaccgattaaattatctcgctcaatgtcattctcagatcttaatacatgtgatgcctctctttgtccaaataattgataagagctttgttaaaggtaggaccaaggacagaatctttgagcacttgtaggggaattaatcaattaatactcctgggctacagtttttcaaccaaatatgaacacacctgattgtattatcattcagtcttgtctataagggcatgaaaaatttggtcaaatgcctttctggccacagcattttcctgattaatccagtaagtttattc

SEQ ID NO: 40534 - DNA, 446 bp, Homo sapiens
aaaaaaaaaaagaaaagaaaagaaaagaaattaaaattctgaagtttgcatacctaactgttcacttacggtatctcacagtctaattaattcatagccacatgcatagagtttattgcatttgcaactatgcagcatcaaattgttgcaaagggacctctggaaaggactgtccttcctcccaatgtgtatgtgtgtatgtacatgtaatacatgtacatataatgaagattacatacatgtataattgtattatatacatatataattgtatacgtatataatacatttatataatcttcaattatatgtatatgtattatatatacatacatacacattgggaaggatatatatataattgaagatacagaattgaagatgagtatatttaatatttatcaaagggtaaaggcgctcatccgcagtttggatcagagcctcaa

SEQ ID NO: 40535 - DNA, 1525 bp, Homo sapiens
gaagccacagaattagtcattatacaggccacaattaatccagcacctctaatgtaaggcactttgcatatatgaactcattaatccatttatcaataaaatgggatggtgttattttctctgctttctcattaaggaaacagagacttagagacatttaatattgtatctaggtttgtgtaagtgctttatggtgagctggattttgaatctaggactgaccccaaatcccatgttattttctctgcaaaatagcaagacagaaagggcttctatatgtacacctgtcttcaaatgtaaaaggactgctaggtggcagagagattagaaatttctgatgctccaagaagttgatctcttacctatgagtggaataatgaagggggacagactctatttcagaataatgaagaaatgactatcttatgaaggtagaattctctaccacagatggtgtttagcacatgactacttcttagggagttttagaagaaactcctatttggatgacccctgactttgcttccaacttccagtatgatgttatagtaagtaaaaagcatgagacaaatctgttagaaatactgtttcttttacatgaactttctcaggaaggatttgtattttagactaattgcatgtggataaagagctgacttccaagataaaaggctcaatagttctccaaagagtttacaagtgcctttctttgaagactgccctattattttggagcttccaagacctggtcagaaatgcatacattctcaaaaatcaaaatacaatcccaaacctccatcatcagcaaggttgcagtataataaagaggctctattactttcctcaatccttctcaaagtgaatggacatcaattaacaagaaatcttagaatcattagattaccctactatagacaatggtttaaggcaattttaatgtgattctgttgtgtgtgtaagataaatattatatttattttcaaatttcctcctgtgttttactacattttgggggagggaatgcccttttcatcttcccacaatctctttcatagacaccctttcaatttttgttttaggaatacatctcctctaataaatcaagggttttctaggaagcacacttttgtcctggacagagcacaggaaaattaaataaagggctggctactgatcagtaaagagaaatcgtagagccaggtaacatcactgctgctgtctccaccactgtcttctctgcctttgccccatctctccctttctcctctttacttccttccagccaagcaattggtgccccattcaacctccagtcctgtgaggagtctgaaatgattctggacttgcagtgactgtttcctttattctttattccccaaaccaaggataattatgagacaaacctaggccaggcatggttgtcacgcctataatcccagcactttgggaggtcgaggcgggaggattgcttgagtccaggatcaagaccagcctggacaacatggtgagatcccatctctaccaa

SEQ ID NO: 40536 - DNA, 420 bp, Homo sapiens
gcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcaggtaaccatttat

SEQ ID NO: 40537 - DNA, 440 bp, Homo sapiens
ctactgaggtttccatttgtaaatttttattcataaatcataaatcagtgagtgaagggctgaaatggcaggcataaagggtatgagtaggagcctagcagagagggcattggggctagttcttgtcgaacggtgggaattgtagaaagagcagagagaagagctttctatgctgtaggagctgttctgtccaaaagaaggaattgtgggccaggcgcggtggctcacgcctataatcccagcactttgggaggctgaggcaggaggatcacaaggtcaggagattgagaccatcctggctaagacagtgaaacccgttctctactaaaaatacaaaaagaaaattagccgggcatggtagtgggcgcctgtagtcccagctactccagaggctgaggcaggagaatggcgtgaacccgggaggcggagcttgcagtgag

SEQ ID NO: 40538 - DNA, 258 bp, Homo sapiens
gcagagatgcatagggcaagaaaaagtggtggtgaaagctggggcaggtaggtaattctgctaaatagctgtgacaaaaaattcctcatgctttttgttctccgaaatcagcttaacgaaaagagacacccttcccattgtgacttcaataatactctctcttctttttttctaaacctaccacagagtcagacacggaccacacatttccatctttttctcatatacaattggctgaacaatttcatcttcgatggt

SEQ ID NO: 40539 - DNA, 390 bp, Homo sapiens
cgggggcttcacctggaccacgcttgggggctgtctctaactcctgtttggcagggcagtctgaaagtctgcagttagaagacatttctgaacagtagggtggagcaagggtctccacagggaggtgagcaggatgcttcgctgggtacacagagagaatattagaacttcaatcattttttctctgccttttaaattatattcctgtacaaattttataacatgcctaccatttaagttcagggtcacatgactttaatttgaaaacagatacacacatattggaaatgtttgcacatatgcacaggggtgtgcattccaaaacactggagaaatgtttttaaaaatacaagtgaccagctgggcgcggaggctcacgcctgtaatccc

SEQ ID NO: 40540 - DNA, 387 bp, Homo sapiens
aactctcccacagggcaacttggcaaaatgctcgaaagccttaacaatgttcttatcctttcacccagtaattctccttctaaggatttatcctaaaaggaaatagagatgcacaaaaaaatacaaatacatggaaattcattgtggcaatatttaaaatagagaaaaagtggaaaaaacttaagttgtccatactatgaaatcctatgcagtaacatttatactatgaaatgcaatgtaattatttaaaatcatgtttagaagaatatttaatgacatgagtaaatgctcatggtctaacttaagtgggggaaaggaggatacacaaacatacagtgaaatcccaagtgtgtttgtgtgtgtgtgtgtgtgtgtgtgtgtgtgtgt

SEQ ID NO: 40541 - DNA, 424 bp, Homo sapiens
cccaaaggcattctttctctcctttcaaggtggcatcacagctgtcaacaggagaacattctgacatatctatcgtccacagataggaagagaccatcaaatggtgaaaagaaagcatttttctaaataaagcatttctgagcataacaagcacaaaactggagaatacaaaggaatgaaaatatagcataagggagtcagaacatctttatccccgagaaggtttttaaaatatttcttcccatgttataaagtactgggtctaccaaacaaatggaaattgtttaaactaataaattcattttgccactttaaaattaaccaaaacacatgtaagaaaatgctagtttctgttcagaatgtaataatcaatgtcattaatttgggctgatacaattataatctaaagcaaataaatttggta

SEQ ID NO: 40542 - DNA, 371 bp, Homo sapiens
atccctctccaatcccattctcctctccttttcctctccattggtaaccactatcttgaagtcgatgcaaatcctcttgcccctgtttttgtatttttactatgtttgaatgtgtttataaacaatgtatgattgttttgtggttttggactttacatgttaaatgttgtgttttatatgtatgcttctacaacttgcttctcattttttgagatttatcaatgttcatacataaaaatctagtttattcatttaactggtattataactgaataaaagtgctacattttattcattcttctgttgatggacctctaggcttctcccctttcttttttcactattaaaaacaatactgaagcagaccttct

SEQ ID NO: 40543 - DNA, 405 bp, Homo sapiens
taagtggggagtgcgctgggcagagccagcctggggagtgggaagggcagctttctgtccacggggtcccttctggagacagagaggagctgcttcgaactagtgacagcaataaacctggtttgcgtgctcagaaatgtgaaagtaaccccaagaactcccaatccaaatgcccccttctctttctcgggccaccagatgatcctggtctctttacagatgaggagatggaggcaagttaagttttttattctaagaaggcagggtaagaggtgggcagaagaaaacagaaggcaggatattaattggattctaggctaacgggcctagcgcaagacccagtcctgtccctcccctgtcctgtgactctgggctcagttccttcatctgtgaaactcctgcctc

SEQ ID NO: 40544 - DNA, 346 bp, Homo sapiens
gaccattttccacacccctatgattgcatccccaacaaatcagcaacacccaaactatccttgaaaaactgtagcctctgaacttccagggagactgatttgcataataaaactctggtctcccattccgctggctctgcatgacattaaactctttctctattgcaatccccgtcttgataaatcagctctatcttggcagcaggcaagatgaacccattgcatggttataggggcacctcccatgagtgggaaggattgggaaagcacccatgtgcatccacacagcggcagtgtgccggggacttagcatggcacacagattccctcacatagagtctaaggt

SEQ ID NO: 40545 - DNA, 222 bp, Homo sapiens
agaccctgtctctaagtatatatatatgagagaaggttcattttttttcaactggagggaaaggacctcacaaatagtgatgcttatggcactgtgtatattagtatttcctgctggatgtagtacaagcaaaagagataaaaattacattaaataaagcaaagtcctagagactcagattgccttttttctgctttgatcagattttcagtctaaatgtga

SEQ ID NO: 40546 - DNA, 592 bp, Homo sapiens
tggcgttttctttgggggggttttgtttgtttgtttgttttgagacactgtctcgctcattgcacttcagcctgggtgatagggcaagactctgtcccaaaaaacaaaaaaagaaaaaaagaaagaaaaaattcaggaatcaggggtctaggagtctccctcagcttgaagagggagtgagcacatgggaattacaaggagagggagttgtaatcagaaagtgagtttaatttctgaaattaagtccatcaagaactcgtgacttccagagggaccctgtgaactagaagtctaaaaggagtaaaggtctttgaagaccaagaggatgagaaattttgagacaaagttgttggatgttcatctgtatgaacactgaaatgtcttaagattatagtaggatttggggaattggggaaagaagattggacaagataaggggttaaaaaaagagtgacaaggatatcagaaggtaacagcaacaaagaacagaagatgaccttagcctcaaagacacattgccaagggtgaaagagaatggtctgaaagcagggtttgacacttaggccaaatgcttgaaagcctaatttgcatt

SEQ ID NO: 40547 - DNA, 774 bp, Homo sapiens
aaaataaaaaaaataaaaaaataaaaaaaaaaatctcactgtggtcttaggggatgttatttcaatagtgaactatgttccctctgggatcagagcaggtgagcccatatccagagctccaagactcagtttaggggaatagatggcaaagcagagaatctagagaagcagcccagggtaggatctggatggtcacctggagaggagacctgcagggaatggatggctgtcttcatccagaaagacagagaatatattccacttacaccagagggcagacaaagctgcctaaccctgatggaggtccagtgagtgcccattgcaggaagcattcaagctgaggctggatgaacatcgacagggctgttgagagggagattagatggcatttcagggtcttttcccttttaagattctggcatggagagctctagttttccaaccagcttcatttatcaaatcaacaaaatgattgaaatgatcagagtttgcagggaagatgatgacaatgctcactagcacccagtttgcatcaaattgaatacctgcattggactgaatattcactaataatacacattgattataagtacccttggccctagtccccaaggtacctgccagtaggagcaaaggggaccctgggagagacccaggagtctatgcaatggaaggacaggtgttaaatatatatatatatttttttttgaggtagagcctgggtaacacagcgagactctgtctcaaaaatacaaataaaaaaaataaaaaaat

SEQ ID NO: 40548 - DNA, 373 bp, Homo sapiens
acaagatcgttcatctgaacagatgcccagatggcccgagtggtttttttccaactcttttgtggactcgaggacatacagttttttaatggagacgctgtgtttttctcattttctttcacagcacacatgttatttccccactgaatacacccactgttcttacccttgcactgtcacccatacaggacgcacagggatggacgcggacggaattctgactcagccacacctggaggaaattattgtgtcaaaaatgtggggacacaagggctggcactgtggtttgcaatggtttactgatgagacagcaaaaatgagacaggaccatcagatgcaataaagattctaatttaaaaagataaaatgtgtt

SEQ ID NO: 40549 - DNA, 721 bp, Homo sapiens
ggccactcgcccacttggggacacactgagagctggagatgctctaggatgcaggaaaacagtgagagagaaacccgcagggatccaaaatgagcttttataatcttgactctgggagaaaccctcaaccactaaggccacaggcctgacatacagagctgcctaaagattgcacagggccattgctgcagaaagggagccctcacagaagcccacaggcatctgaacctggaataacctcaactgggagccatttgagagcccagatgccagggatctacacatgtgggtgctgctcctagggggaagtggggatcctaggggctgtcattcacccctgggagggtccctgccaccctgcagcaggctgctgttgagactgcgatgtgaccggaccacactccccccagcctgttgcccatgctgcttgcctgagatgcgccccatcctctctggtccaaggctgaaagcaccattttcagtttatcactgggctgcaccccacattcaggccaagttggaggcaatgtgactgaatctattgcccagttgggagaagaaaaggggagtccaagctcttctaagcacacgcattaccctacccactgcccttatcactttatgtggttccagatatcttgaaggttttgctcattcttcaatcttttttagcccttaattttgtttgactggattgtttcaaaagatctgtcctctacta

SEQ ID NO: 40550 - DNA, 345 bp, Homo sapiens
gttttggtttggtttttgcttttttgagatggagtctcgctctgtctcccaggctggatgcaggtcatggtgcctttggcaccatggtgaatagaaaggtgagcagagccactgctcagagttggctttttgtttctcagaaagtatgtgtctctgtcctgagtgtgactaaggacttggtaagaacacaccaattgagaagacactcagttggggtgttaatttccatttctgtgtcctagaggttctcactcccctctccaacaaggaaataggcagtggattggtggggtctcatctggtgcaggctcacctcagtagccatgggatccctccctgacaggt

SEQ ID NO: 40551 - DNA, 684 bp, Homo sapiens
taaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttatgatgaaagaagaaacccttctctgccttctctcccacgaattctgtccctgtatcctctggatgtaaaaagcaaggagagaccccaactgtctccatggagaagaactaggaatcaccacaaggggaagaaatgtacatgaagtctccattacctcgaatttttttctcagtctcactggttgtgatttggtcactttagtgttgggacaggggaaagggtctgtgcgtgggcaaagctgaaggtgatgaggaagaagagacgaacattaaagatgtctatttactatgaaaaaaatg

SEQ ID NO: 40552 - DNA, 440 bp, Homo sapiens
taaattgtatgtgtacttgcatctaagactgtggtagagaagtaaagagaagtcaattccttcttcctcacctctcagcctccagatcccttcctgcccatcccttccctacaatgcccactccagacgcaaagatacacttttttcctttggactgtgaacatggaagcctcagcctgaatgtgagtggcaagtggcttatctggagccacctgcccaagtcttactaaaatgcagctgttgttagacaactgttgaaaactccagaaatacatcacccaaggtggcagttctcagtatttggcagaacaattgcaattgcactgggtatattatatatatatatgtatgcatatatatcatattttttacaaggaacattttagtgatgaggaagaagagacgaacattaaagatgtctatttactatgaaaaaaatg

SEQ ID NO: 40553 - DNA, 251 bp, Homo sapiens
gcctctaagccctcagggacagtgcacacgtggagagaagtcctttgggggattgagcagttttttgagcaagcgcatatgtaaggagcacatcagaagctctggagaggcaaagtcaagcctttgaagggcataggcccaagcactggctgcccaagagaagccccaggcccttctctgctggtagcatctgctccctccaggtgctggcggcatcacctagtcatgcaggtgacatggggcctcacaca

SEQ ID NO: 40554 - DNA, 433 bp, Homo sapiens
gcgtcctcagctctcacacctgccaggcctgtcatcccctgcaggatgaagcctggtgtccatggcttgcccttagcacctcccacaacattgtaagccttgtagctccttcctatgggctgctgaatccacacagccctgaacgtcacagccagcctccccgactcaaaccccacggaagctcagggttcgttcaattcctgaatcctgcatggagccctgcctgctccctccctgtcacctcagcctcacatcctctcctctcactgccatcgagggagccctttgaggccacctttccatttctgagccattccccctaagcctcacgagggcaaggaatgtgtctgaataacaacagcttccatttatcaagggcttgctatatgccaagccctgtgctagcgcttgacgtgggcagcagggtctccca

SEQ ID NO: 40555 - DNA, 1746 bp, Homo sapiens
aaggaagagaagtagaatcagaagttaggacatctattgcttgatgcttctgggatgggtaagacgtagttctggtgatagaagttgaagctgcagcataatgagagatgaaagagaaactgctcttctggtgattttaaccctagggatgtagctactgggacaggaggaagtgagggacccagtgctgcagggtccctgttgtcacatatgtcaatcctactttaaagtcaaataatggattctggctgataaagcctatcagaattatggtgttgatacgaaagtgtcacatagccaccaaaatgtgttctctactttcttgctttgctctgattagctaagtcttggtcacatggctttatagcactgggaaaaccaggatctggtcttttatagggtaggaagtgagccctatcttttgtgtagatttgtggcggggagtttcccaagcatgggaaatgggctcagatgatgtggttataaaatgtgaatgtccattaaaaggcagtcagtgttggctactctaagccttcaaattgttgcttttccccttcaacagggaccaaggggagatactggaaacctctgagcttcagctgttggtttttgggttttgtttttgttttattgagatacagttcacttaactatacagtttacccatttaaggtatacagtgttttttagtaaatttacagaattgtgcaactattacaattttggaacatttttgacacctccccccaaaaaaacccctatgccccttagcagtcatcctcagtctcctcagccctaggcaaccactcatctactttctgtctttatagatttgcctatttgggacatttcctataaatggaatctgtatgtggtctttgcttggttttgtttttggggtggtgggggctgactacttagtcttgacaagccaaggtcccaacccagcagtagaaatataaggagtcacggctgtgaggatggcctcacaatgggctcagggtagtgaacttctgtcccctaagttatctcagaaatgaggccaactctctgccctctagaatggatggccctgagggagagaaaggttcatgtccttcctggctggtgacagaaggctggactgtgcctgaaatcaaagcttctcacctggatttgggcaaatcaagcagtcccgaatctcagggtggggtgagatgtgtgctgaagagggcaacacaggagctgcactgcagatggcgacatgcagggtttcaaggccaaagctggtgtgttcttcccttaagaattgctgtaggctaggtgaggtggctcacacctgtaatcccagcactttgggaggctgaggtgggcggatcacctgaggtcgggagttcgaaaccagcctgaccaacatggagcaaccctgtctctactaaaaatacaaaattagccgggtgtggtggcgcatgcctgtaatcccagctactcgggaggctgaggcaggagaattgcttgaaccccggaggtagaggttgcagtgagccgagatcacaccattgcactgcagcctgggcaacaaaagcgaaactccatctaaaaaaaaaaaaaaggccgggtgcagtggttcatgcctgtaatgccagtgctttgggaggccgaggtggctggatcacctgaggtcaggagtttgagaccagcctgaccaatatgatgaaaccctgtctctactaacaatacaaaaattagctgggcgtggtggcggga

SEQ ID NO: 40556 - DNA, 745 bp, Homo sapiens
  misc_feature (535)..(536): n is a, c, g, or t
  misc_feature (543)..(543): n is a, c, g, or t
aaggaagagaagtagaatcagaagttaggacatctattgcttgatgcttctgggatgggtaagacgtagttctggtgatagaagttgaagctgcagcataatgagagatgaaagagaaactgctcttctggtgattttaaccctagggatgtagctactgggacaggaggaagtgagggacccagtgctgcagggtccctgttgtcacatatgtcaatcctactttaaagtcaaataatggattctggctgataaagcctatcagaattatggtgttgatacgaaagtgtcacatagccaccaaaatgtgttctctactttcttgctttgctctgattagctaagtcttggtcacatggctttatagcactgggaaaaccaggatctggtcttttatagggtaggaagtgagccctatcttttgtgtagatttgtggcggggagtttcccaagcatgggaaatgggctcagatgatgtggttataaaatgtgaatgtccattaaaaggcagtcagtgttggctaaaaaaaaaaannattacancaaaaaacctcttcaaaattaaaacaaaacattggggggggcctcgtacccaattgcccttatgggggcgtttaaaatccacgggccggggtttaaaacggggtaccgggaaaacctggggttcccatttaagccttggaaaaattccccttttcaagggggctaataccggcccccacattcgctttccgtcgccccgtgg

SEQ ID NO: 40557 - DNA, 385 bp, Homo sapiens
tgccgtacatacatatctcttcatctgactcttcatttggatccttcgaaatatcctttgtaattaatcagccgtaataagtaaattgttttcctgaggtctgtgagccactctagcaaattatcaaatctgaggagggggtggtgggaccctccaatttgtagccaagtcagaccgaaactgtgggtaacctgaggacctaccatttgtgattggcttctgaagtgggaggcagtcttgtaggatggagaccttaacctgtggggtctgcactaactccagttagtgtcagaatattgaatggaatcataggacattcaactgagtcagagaattggtcagtgggaaaaaccaccacaaatctggtcacagaagtgttgagtgt

SEQ ID NO: 40558 - DNA, 1005 bp, Homo sapiens
tagttaaaaaaaaatgcttatgtttttataagcatagccaaaggtctggaattttgtggctggaggggccctgtctcgttcatctccattttgcagaggtggtgactgaagccactgagtgtcggtgctttactcatggtcatccagttgatccctcagtggcagaaccaggcctgggagcctgtttctggctgcctggtccagtgcgctttgggaggtcacaacccaaacctagtctggggcaagacctccctttgggagatggcctctgatatttttggagcaccaggtcttccttagtgtttgagaccgtctcggagctgactggctttcacatgagaaacagttgggtctgtgttacatgtgtgtctattattttatgggataatagttcagggccgtcagggggaaactcagtccaggtagctcacagagggacccactgtacataagcgagcatgacctgtgcaggctgcactcctttgcagagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgcca

SEQ ID NO: 40559 - DNA, 793 bp, Homo sapiens
gtgtaagcctgagtggattttgcttttgatttagctttaagtaactataaatcttcgtttttctaaggaagtgtttttggttttgttctgaattctcttccacgattttctgtgtgtggaggtaaatccacttgctgattcacactcatagtcctcagacggtctttataatcatcaaagaacaggaaaacagaaccaagaatatacaaaatattctgcttgtgcttatactttctcatttacagtgtttacagaaaatgattagttggagtttgactctctttagaatttttgtaaagtttccttgctggtctaaaacaaaataatactttaccacagggtcattaatgttattcatcagttctagaattcagctatgagtttaggaaaagaaaacccgctggcaagtgtagctggctggcatttattgaatgttcctcgcgtggagacattgttcgatctttcctgatttcatcgtgtgctgctgaccctgcaggcaggccttcacgttttaatcgggtttctcaccttctgcactaacaggagtatgtccagagagtgctgctggttgtcacagcattgtctgtccctgtcctcttcttgggaaagccactgtttttgttgtggcttcacaatgggcgtagttgcttcggggtgaaccgggtaagtgcgggtttggatgcatttacaactgtgagcaaagcttgctttcggttatacaaggattggtgtagaaaacacctcctggagggtccctgtctcttgatttaaaagccacgacagctccctttat

SEQ ID NO: 40560 - DNA, 568 bp, Homo sapiens
aagagtatgaaagacacaggccagtggcttcctcccaccccatagccttacttgtccacttccgactccatctcaaaaaaaaaaaaaagaaaaaaacaaaacaaaaaaacccactgtttttggtatactgcatgaagattattggaattacacttggaactaattactaccctcttaagtaaccattgttttgttttaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgaggtactgaacagctcgtgaggaaatacagctgtttttataaacagctttttataaaaatctcattcccataggctgtgtattttgctattagttcatatagatatgttgcttcttttaagagattaaatttatttatttatttaattttatattttgtttttgagacggaattttgcactccagcctgggcgacagagtgagaccctgtaccctgtatctaaaaaaaaaaaa

SEQ ID NO: 40561 - DNA, 540 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacgtgagtgtcgcccgggagacgcgggccgcacctgctctcctggcgcccccaatcccgcgcatcgctggggccctcccgcggggagcaccgaggaagggcgcgccccgtccccattgtccagacggggaagatgacaccccagctcagcggccaaagcttcccggagcgcggggctgactccagggtcgccggccgtctgtgtggtcggcggc

SEQ ID NO: 40562 - DNA, 550 bp, Homo sapiens
caccgtgttggcccggctggattttcaggcttttttggtaacagttgacaaattgctctcaagaaaagttgtgtcagtttatagtttcattcaatagtatacaagagtgtacatcccccaaactttggtgatgttttattttttacataaaagtatttttaaattttagaaatttaaaccatatttttcatccttttctcagctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggtaacttgcttctgacgaagctggttgcagccattgatcttgggggctgcttacttacttatttcatgttgtctaatgcttttctgcctttcttctcaaaactatggaagatggtgatctctctaggcagagagattaaagaccgctattatgattaaccctcagtaatag

SEQ ID NO: 40563 - DNA, 3021 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagcgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgtgggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaacgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgcca

SEQ ID NO: 40564 - DNA, 2752 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagcgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgtgggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaacgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacgtaagttcctgcttagacctgcagttcccaatgccctgtagtgccagcagactcagggggcactgtgggatattttaactttgtaactaatagtcatagcaccatctttcagctgccacgtgaacttacactattcactacttaatacacagctctcttggctatttcttttggctgaggagtgctgtggaaaaatcacagagggagtctctctgaggctggtctggcttcagagcctgcccaattta

SEQ ID NO: 40565 - DNA, 1314 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagcgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctaccatcccctcacttcatgaatgatcgtcgcaccactccttcgctctgat

SEQ ID NO: 40566 - DNA, 1418 bp, Homo sapiens
gtgtaagcctgagtggattttgcttttgatttagctttaagtaactataaatcttcgtttttctaaggaagtgtttttggttttgttctgaattctcttccacgattttctgtgtgtggaggtaaatccacttgctgattcacactcatagtcctcagacggtctttataatcatcaaagaacaggaaaacagaaccaagaatatacaaaatattctgcttgtgcttatactttctcatttacagtgtttacagaaaatgattagttggagtttgactctctttagaatttttgtaaagtttccttgctggtctaaaacaaaataatactttaccacagggtcattaatgttattcatcagttctagaattcagctatgagtttaggaaaagaaaacccgctggcaagtgtagctggctggcatttattgaatgttcctcgcgtggagacattgttcgatctttcctgatttcatcgtgtgctgctgaccctgcaggcaggccttcacgttttaatcgggtttctcaccttctgcactaacaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgcca

SEQ ID NO: 40567 - DNA, 1120 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactacttgaacaaaatcgagggactattttgaaggcaaggtggctaatggtaaaaggccggcggaagtcttggtcttaaccaggccggtggttgaattcccaagggttggaaaggaaaaaaaaattgtgacaagggggggcccaaattcctttatttcaacaactgggcttggaaa

SEQ ID NO: 40568 - DNA, 1417 bp, Homo sapiens
ttggaggttgtggcaggagcagccagtgtggttgggggtacgaggctggacagggaagtagcggctccccgcaaagaacagaggtgcagtcccaggaagacagcagagcatggcctcctttcttttcatggaaactttattttggccatttagtgaggaccaaacaaaatgtcttataatcaacattttgtaattattatgtaatttcgtgttttaattcgggacaattaataattaagttctaggatcatagagaaacaaaagcagagctggaaagcgcatgagagtcaccttgcctggtgctttgcagccctttccctgtcaggggccccttgcatagttttccctggttggctctacttagaatgctcacatctagtgaatcgcagtctactcttagggttggtgaatacctattttatcagtagatgtttcataattactgagacctgccccagaatcccattagtatagcagctgtggccacggcagttcctctggtctaccttcttggtttacacaggggagtctgaggcgtgcggtgggagtggggctgatgaaggtggggatttggggtggtaaagtctggtcatggagctgggtagtggcagagtggtgaacagagtgcgtctggggtttctgttcctcacactctagcgtgttcttaccagcatccagccggcagctctttcattgtaatccttgaagtggaacccacttggcatgtagaagtacacatgtaacatcatgactcttaacatatgttgtgtgatctctctcagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgcca

SEQ ID NO: 40569 - DNA, 1148 bp, Homo sapiens
ttggaggttgtggcaggagcagccagtgtggttgggggtacgaggctggacagggaagtagcggctccccgcaaagaacagaggtgcagtcccaggaagacagcagagcatggcctcctttcttttcatggaaactttattttggccatttagtgaggaccaaacaaaatgtcttataatcaacattttgtaattattatgtaatttcgtgttttaattcgggacaattaataattaagttctaggatcatagagaaacaaaagcagagctggaaagcgcatgagagtcaccttgcctggtgctttgcagccctttccctgtcaggggccccttgcatagttttccctggttggctctacttagaatgctcacatctagtgaatcgcagtctactcttagggttggtgaatacctattttatcagtagatgtttcataattactgagacctgccccagaatcccattagtatagcagctgtggccacggcagttcctctggtctaccttcttggtttacacaggggagtctgaggcgtgcggtgggagtggggctgatgaaggtggggatttggggtggtaaagtctggtcatggagctgggtagtggcagagtggtgaacagagtgcgtctggggtttctgttcctcacactctagcgtgttcttaccagcatccagccggcagctctttcattgtaatccttgaagtggaacccacttggcatgtagaagtacacatgtaacatcatgactcttaacatatgttgtgtgatctctctcagtttaattttggagaaatattaatgacccaagtaatccattccatcgagtactgtctgggatgcatctccaacaccgcctcctacctgaggctctgggcgcttagcctggctcacgcacgtaagttcctgcttagacctgcagttcccaatgccctgtagtgccagcagactcagggggcactgtgggatattttaactttgtaactaatagtcatagcaccatctttcagctgccacgtgaacttacactattcactacttaatacacagctctcttggctatttcttttggctgaggagtgctgtggaaaaatcacagagggagtctctctgaggctggtctggcttcagagcctgcccaattta

SEQ ID NO: 40570 - DNA, 523 bp, Homo sapiens
aagagtatgaaagacacaggccagtggcttcctcccaccccatagccttacttgtccacttccgactccatctcaaaaaaaaaaaaaagaaaaaaacaaaacaaaaaaacccactgtttttggtatactgcatgaagattattggaattacacttggaactaattactaccctcttaagtaaccattgttttgttttaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgaggtactgaacagctcgtgaggaaatacagctgtttttataaacagctttttataaaaatctcattcccataggctgtgtattttgctattagttcatatagatatgttgcttcttttaagagattaaggatagagagataaggaagagagattcaaggatagagagattaaggatagagagattaca

SEQ ID NO: 40571 - DNA, 3454 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagcgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgtgggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaacgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgccaaacgttatgttaaagttattttttcaaatacaggatttggggagagaagccaattttgcatggctagttgaaaatggtattagatacttatttcctttaaactttatttaaaacaaacaacagagttaatctgtcacctgaagttgccagataatattttccaacagctgaagtagggatagttttttacaaaaatttaatgatgggtaatcaaaacattcacatttattctgctggatttaaaaatatgtactttttttttttttttgagatgaagtcttgctgtgtcacgtaggctggagtgcaatggcacgatcgtgtctcattgcaacttccgcctcctggattcaggtgattctcctgtctcagcctcccgagtaactgggattacaggcatgcgccaccgtgaccagctaatttttttgtatttttg

SEQ ID NO: 40572 - DNA, 1641 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagcgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacacttctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcagtcaccttcacggtttctatcttgctcgtcactcgtccggacgaccttcggcaccatcgcttcgtgactgtcctctactctcgccctctctgtgggtgtcaccttgccatcctccccagacctagctccgtccacgagatctgacgctgcctccctgggcgcggcgcttcttcgactgatgcccttcgtccctcgtcccgtgctctcctcccgctcgctcctacccgcgccccttcccacctgctgaatttcggctcacgccgccccctccctctgccgc

SEQ ID NO: 40573 - DNA, 1827 bp, Homo sapiens
agagtaggaaccacctatttgagagataaacacagatgattcttcttttactgagagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgtgggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaacgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgcca

SEQ ID NO: 40574 - DNA, 874 bp, Homo sapiens
gacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgtgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgaggtactgaacagctcgtgaggaaatacagctgtttttataaacagctttttataaaaatctcattcccataggctgtgtattttgctattagttcatatagatatgttgcttcttttaagagattaaatttatttatttatttaattttatattttgtttttgagacggaattttgcactccagcctgggcgacagagtgagaccctgtaccctgtatctaaaaaaaaaaaa

SEQ ID NO: 40575 - DNA, 581 bp, Homo sapiens
aatgttttgattacacatcagtattaggaaaacatgtttgaagcattgtctaagtctgtttgtgctgatgtaacagaataccatagactgggtagtttataaagagagaaattattggcttacagttgtggaggctggaaagtctagtatcagcgtactgggatttggcaagggccttcttggtgcatgatagtatggtggaaggtatcacacggcaggcagaaaggcagagagagaacaaaagggggcgaacccactcccttgatgagaacctaaatacctcttaaaagtcctaactctcaatgctgtttacaatggcaaccaaatttaaacaagagttttgtagggaacaaacactcaatcaaaaccatagcaagtatgtaccatgactgtatgtgtatttataaaatacattcatatatttctacagcaatatatatgaggtacatttaagcatgtaaaaataggaatttttaaaaataggacagttgtaataatttctttgtacattccactttggagactgtttttatatggagcttgttttatcaccaaaaggcattttaattttgcacacttta

SEQ ID NO: 40576 - DNA, 529 bp, Homo sapiens
ctgagaagattagtggtggtatcaatgaatataatttctgatatttcaccatgaaatgtgtcagcatttggaagctacgcataactcagcaaacaaatggttcctagttaccgatgtatgattttacaaaactgtaatgggtaatccatcaaagtacaaaataccaacagattttaagggaacactgaaaacttcattgatgtggtttcagatttcatattgcaactaacctttgagaaacaactgtgtttttatgtagtatcaaagaataacacctatagttatctgaaaatgctattcaactacttacctcttttcaactgtatatctgtgagagtccagattttcttaatatttttggaccaaaacaacatattgcaacaaattgaatgctgagatagatgtgacaatccaggtgtcttctactaaccagatgttagaggtttgcaaaaatatacgatgccactcttcatacaaaatatctttgttttggaaaataataagtttttaaaataaaaatatgtcattt

SEQ ID NO: 40577 - DNA, 252 bp, Homo sapiens
tacagacagggtcttgccatgttgccaaggctggcctggaactcctggcttcaagcaatcctcccaccacagcctcccaaagcactgggatttcaggtgtgagccaccatgcccagcctggaatctatttttaaagccaatcaagcgttgaataaaattgcaacttgggctgttttttctttgcattttttacatttcaatggttttcaatatattcagagatatacacaaacattaccagtcaattttaga

SEQ ID NO: 40578 - DNA, 876 bp, Homo sapiens
aagatactgttgccccaagtagatatcataatttgttacaataagtaaaaatgtatattattcaatactaaactgttataccacatttcaagtttttaaaactttatcttccttttatgcatagatagtagtagagcattaagaacatgcatggctatcacctgaggtgttgattgtaaattcacattcctaggctttgtctcttaactactgaatcggaatctttgggagtgaactgacaggaatctgaattttaaaaataaggtcttcaggtgattctcatgcatctaaagataactgctttaatatataacaaagaaacccaaagagggacacttgaggattttttcaatatatcttcttttgcagagattaatagtgaatgttgttttatctgctgtttagaattttacatatgcattggatgatacatcttcttttactgacaaaaaggcttttctctggagaaaataaaaaggcagctttccctgagagcacacacttctagcaaagccccaatccatatgactctaagacagagtgatttccaccttctagtccttactttcttgcaaaaggggctttcaaatctcattactgatggtcccatcttttattactggtgttatcaatgggatgcttgcagcagcttaagtatgtggataaagaaggaatgcacaatatacggtactgaatatttttaaaaagtggtctttcagaatgtctgtatgtgtgggggcccatgcttaggcatatgtgcatgccagtgtgttatttatgttgaaaccaatgttttacattaatggctggaattccagaaaaataagaaaatatttgtattttctaaaccattaaaagtttagtggaactcattaa

SEQ ID NO: 40579 - DNA, 531 bp, Homo sapiens
aagtccatgctaatttacttctttctttgcttacaccaataatctgttagcagttaacaaggaaaacagtaagattaattttggggatatactatagcttgtgatgtgcctcctatggacattcctagtgttacgccttgatgttcctagctgtcagtgtcattagcctaagaggaaagaaattccatttggaataggttaggttatctattagaaattaggctgggtccaggtgcagtggctcatgcctgtaatcccagcactttgggaggccaaggtgggtggatcacctgaggtcaggagttcaagaccagcctggctcacatggtgaaaccctgtctctactaaaaatacaaaaaaaaaaaaaaaaaaaattagccggacgcagtggcgcatgcctatagtcccagctacttgggaggctgaggcaggagaattgtttgaacctgggaggcggaggttgtagtgagccaagattgcaccattgcactccagcctaggtgacagagcgagactccacctcaaaaaaaa

SEQ ID NO: 40580 - DNA, 520 bp, Homo sapiens
caaactgctgggctcgagtaatccacccctctcagcctcccaaactgttgagattacaggcgtaagccaccacgctcaaccaagactgagtttcttaaaccaaataaaaattatgggagattacttgagcccaggaggttgacgctgcagtgagccctgattgcaccactgcattccagtgtaggtaacagaatgagactcagtctcaaaaaataagataaaataaaataaaaattagaccgggcatggtggctcacgcctgtaatcccagcactttgggaagccaaggcaggcagatcacgaggtcaggagatcgagaccatcctggctaacatggtgaaaccccgtctgttctaaaagtacaacgaattagccaggtgtggtggcaggtgcctgtagtcccagctacttgggaggctaaggcaggagaatggtgtgaacccgggaggcagagcttgcagtgagccgagatcgcgccactgcgctccagcctgggcaacagagcaagactctgtcttta

SEQ ID NO: 40581 - DNA, 253 bp, Homo sapiens
ataattttgatggttgaatactaaaacatatgttcattcactacattttcataaaaagtgtattttaattttaataaagaaatgaatatgtggttctaaaacattaactaaatatttttaatatctcatcatgacaagactggataatatattgatttgaaagcacaaaaacgaatggacttttatgactccatatacccggaaatatatgttcctctgtacgtacaattgagaaccatacatagttctattt

SEQ ID NO: 40582 - DNA, 549 bp, Homo sapiens
  misc_feature (42)..(42): n is a, c, g, or t
ccatttacactgaagatcgatctgaaactcagcaccagcganaatccagaacttgcctgtctccatggctggttttaatttccccattctgcagtggcttgttaatattagttctgacctttggggcaaggtgaacacatggttggactgaagagaaaaggcttctggtggctcaggaacgtctttggcaactacaacagctgatatttcaacagagcacatacatcccccacttaacaagggtacgtcctcagccttctcagggaaccaacgaacacctccaggcttcctctttgatgccacccactggacctgccttgggggtctgtaaatgcaagagaaccgagtgttggataattagcgatggaagaaaaaacctctagaataaaaggtaggtgagaaagaagggaaagtaggcaggagttgcacaaatccacatccattcttcaggccctctggaaagttttctttgcatagatggttggttgtcgtgtgcattaaagggcatgggaaagtgggggaaaagattatatctatatgtaacctaat

SEQ ID NO: 40583 - DNA, 610 bp, Homo sapiens
  misc_feature (42)..(42): n is a, c, g, or t
ccatttacactgaagatcgatctgaaactcagcaccagcganaatccagaacttgcctgtctccatggctggttttaatttccccattctgcagtggcttgttaatattagttctgacctttggggcaaggtgaacacatggttggactgaagagaaaaggcttctggtggctcaggaacgtctttggcaactacaacagctgatatttcaacagagcacatacatcccccacttaacaagggtacgtcctcagccttctcagggaaccaacgaacacctccaggcttcctctttgatgccacccactggacctgccttgggggtctgtaaatgcaagagaaccgagtgttggataattagcgatggaagaaaaaacctctagaataaaagaactctccaccccaaatcaacagaatatacattttttccagcaccacaccacacctattccaaaattgaccacatagttggaagtaaagctgtcctcggcaaatgtaaaagaacagaaattataacaaactgtctctcagaccacagtgcaatcaaactagaactcaggattaagaaactcactcaaaactgctcacctacatggaaactgaacaacct

SEQ ID NO: 40584 - DNA, 188 bp, Homo sapiens
gagagcacacctccctactgccatcccaaagaggtggatcttccaaaggctgccaggcaaggacaacattttatatttctgacgctaggattattttcctgtttcatggatggcaaaaccaaggcacgaagaggtcaagtgctttggctctgttgatgaaagcagcctgagcatggcatggtgaactc

SEQ ID NO: 40585 - DNA, 464 bp, Homo sapiens
agggcctgggattctgcatttctaacaggcttccaggtgaggccaaggctgctggtcctaaccacactgtaaggtcttggggaactgagcataaaaaataaaatgtccatggcaatataatattggcttttaatatattttaaatatttttagatggtcctatagatttctcctctttgaaatggaacttaaagttaactaacattgttcatgcttatttttcaacttaaattgtcccaacaaaattgagggggttctatcttgatattccacttctggatttaagcatcttactcagggagtaagtcctggctagctgtgtttccttgtatgtatggatcattgcggtgctgtgtcagaggctggagtgaaaggccatcatgcagcccaatcccaacactaaaatcagagtagggtgacaggcttaccacccagaatcacctcctaataatcaggaagttatt

SEQ ID NO: 40586 - DNA, 312 bp, Homo sapiens
tcacgcttgtaatcccaacactttgggaagtcgaggagggtggatcacttgaacccaggagtttgaaaccagcctgctcaatatgaccaaacctcatctctacacaaaaatacaaaaaaaaaaaaaaaaaatatctgggcatggtggcatgcacctctggttgtaatcccttgggaggctgaggtggaaggatctcctgagcctggggaggttgaagttaccgtgagctgtgatgccaccactgcactccaggctgggagacagagtgggaccccgtctcgaaaaaaataaaaataaaaatttggcctggca

SEQ ID NO: 40587 - DNA, 874 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaaagtttctgagtcctaattttggcaaaataaataacttatggtaatctggaattgtattttgtaatattaagtgttttgaacctctaacatttacttcccaaaatcaaacttcagtttcaaaatt

SEQ ID NO: 40588 - DNA, 679 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaa

SEQ ID NO: 40589 - DNA, 803 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaaagtttctgagtcctaattttggcaaaataaataacttatggtaatctggaattgtattttgtaatattaagtgttttgaacctctaacatttacttcccaaaatcaaacttcagtttcaaaatt

SEQ ID NO: 40590 - DNA, 2093 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtatgccgcagcacactacatcatctcgggtctccttgctcttctgcagctcttcattgctacccaagttatttgaataccccagggatgcttacccccgggcctatctgatgtcttttactgttgtgccaagaaatggaatctttaaccagagtggagctacccaagttctagaagatcataatgtgattgacttagtttcacagattaattcattttgcttttaccttctgaaataaaatatactgtttcatttttaattttaaatacactgtttcatttttttgtggaaggaaagaccaaatgtttacactgactctgaactagttatcaaagataaagatttagatttcaaattaacatgtcatgacaggccccattcctttgtctgtcgtttctaactcctttagcagtaaagtttgacctgaagggaagtgaggctatgtgtaactgaatgttccctttgtgtaaatattcataagttttctacagaaatattgtgtttgattacagtacagcttgctggaagtgtttcataatatatggcagacgtactattctaagaaaagttctgaattttgaaacatatctagccaaaaagattttaaataagggattaggaatttgtagttgtaatttctgaaggtgtgataaagaactttttctttcatatataagtgcgatgctctggatgatgttaaagtttgcttacaagataaagtttttaaattgagtaactaaaaactactcagaaaccttcgttgtattttttttctcctttttagtgagtcttggcatctctttaaaagtttatgcatgtttaatgcctgttggtgcatagaatttagaaccatttcgcttcactctttttcctactcttgttgtttatttcaatggaaacaagatgtttctgtaaagattcctgaattatcggatagacaaaaaggtgtgggagtgaaaaaatgaatggaacacagatttgagtatgtagaaaaaaatcttttaaaatatgttatactgataagcatatgtaccccaaatcaccaaaaacaggtattttaaaatatgtttggcttcaaaatgtgtgatatatattttaatgaaagattccaaattatgttgcattcaggttaaacttgaacgagtttgcatttcttagagtggagcgggagatattggctggtaaggaagatgttttaggcacttgaagtatttgtgatagcaagaagttgttccaagattaaaaattgactatgagtcaaagtaactttttggaggaaaatttgtaagtagtacaagtggtgataattttttaagttgccattaaaaaaatcttttatttttgttcttctgtagttcttactcagcataccacaaattgcaaaagactttatagataagtctagataaatttcaccattaaaaagtattaaaatgctagactaagaagttcatgtttcaatctgcataactggcttcctgctaagatttgtgactctaataagtaaggagatatggtaaatagccctaatctatgggagacctgtaacctcctttcattctgatgtataaaatgaacatgttgaagaaataattttgtga

SEQ ID NO: 40591 - DNA, 559 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaa

SEQ ID NO: 40592 - DNA, 819 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagagtgagtaaatgagattctaaaactaaacaagggaggtcagagactctttccaaccttacctgatggcttctggccaaagcaaggaagtgtcttggaaggtgttggttggtgatggtgcgaaaagacacttgagaaggagggaagaaaaagcagcgccccttgataa

SEQ ID NO: 40593 - DNA, 588 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcagataaactgccagggagaagaatgagaagacaggagacaaactgtttggaaagctaaatcttccctcttaatgaataaaggtttttgccttgtcttaa

SEQ ID NO: 40594 - DNA, 521 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcgaagcgcttaggtaaggcactgtaggtaaggcgctgtaggtaacgcgctgtata

SEQ ID NO: 40595 - DNA, 612 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaaagtttctgagtcctaattttggcaaaataaataacttatggtaatctggaattgtattttgtaatattaagtgttttgaacctctaacatttacttcccaaaatcaaacttcagtttcaaaatt

SEQ ID NO: 40596 - DNA, 488 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaa

SEQ ID NO: 40597 - DNA, 750 bp, Homo sapiens
acgtcgggggcgagccgggcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaa

SEQ ID NO: 40598 - DNA, 215 bp, Homo sapiens
cttctccttcaagtctccacttaatgtcgtctcctcagggagaccttccttgaccacacctagaatatattttccccctcacccctgcatcactgaatacatggagaatggaccagggtgtttctaaatcccttctggttcttatcttgtgtattttccacaatgttattattttttaggcacagggttcctcccataagcctaggctattcatt

SEQ ID NO: 40599 - DNA, 266 bp, Homo sapiens
gataagttctcaaccttggttatatattggaatcactttaaaattactaatgccttggcattttacgaaggtctctaggtgattttaatatgccacatgctagaaggagcaccctcactttacttgggcaagttcaatcttacaatatacctgatagtacttcttgatttctttgactttaatgaccatctgcaatgtggttacctgctgatacaattgcctcctaaactagtggttttcaagtgtcaaggtgcataggcatttcc

SEQ ID NO: 40600 - DNA, 407 bp, Homo sapiens
tatcactgtctgtatttaaatgtaattggatattttatatccagccatgttcctagtgggattttagacatcgggcaataatacatgaaatacacccaaataacataattcatttgtgagtgaaagacttttagttcccttctcttaaccgagaatggagaggaagaattcaggaaatgaatgtcaactagtagggaggaattatggggaagtgaagatttctttgatttgagggtgccaatggggctgggcagaggcagagccagaagaatcctggttagtttaactctgaccagtttgatcccaatgttcttggcttggggagtccttggtgacttgtgcgtagattatccatggatatttcaagggggtgggaagtgagagctgaaattaagtggtctcaggaa

SEQ ID NO: 40601 - DNA, 1812 bp, Homo sapiens
agcggaaattttcctccaggctgtccttggagaattccaccctctttcattctggggagaagaagttaaaattagggccagccctgcgggactgacatgccagatgcagggaagctgtccccagaaataagcgagttcccaccgcggctgggcggggcgggagcctcgggtcccaacccagcggagggactcctggaaggcctgccccttccaagtgtctgcaagggctctggtcccaagctttaaaatcctgagcgaaggcactgcgggccgacctctcctctcccagccagtcgtggctggcctttcaaagtgtgcagttgtctcctccctgtccagccccatcgtcgcccaggaccagctgggccgcggtctgacctgaggctgctgctcagcgccggggcgctggcgctctccattcgagcaccttccagcataccgctcggctccgggagccgctctgcaaagttgggcagctcagagcgcaagctttgcctctcgacttctccctccttgggtccccggcgcccccgcctcccacgatccctttcactaggagcagccagtcccagcgggctggcaacttgcaccccttcctagtcatcctccctgaaacgcgaccatgctgttaaggggcgtcctcctggcgttgcaagccctgcagctcgccggtgccctcgacctgcccgctgggtcctgtgcctttgaagagagcacttgcggctttgactccgtgttggcctctctgccgtggattttaaatgaggaaggccattacatttatgtggatacctcctttggcaagcagggggagaaagctgtgctgctaagtcctgacttacaggctgaggaatggagctgcctccgtttggtctaccagataaccacatcttcggagtctctgtcagatcccagccagctgaacctctacatgagatttgaagatgaaagctttgatcgcttgctttggtcagctaaggaaccttcagacagctggctcatagccagcttggatttgcaaaacagttccaagaaattcaagattttaatagaaggtgtactaggacagggaaacacagccagcatcgcactatttgaaatcaagatgacaaccggctactgtattgaatgtgactttgaagaaaatcatctctgtggctttgtgaaccgctggaatcccaatgtgaactggtttgttggaggaggaagtattcggaatgtccactccattctcccacaggatcacaccttcaagagtgaactgggccactacatgtacgtggactcagtttatgtgaagcacttccaggaggtggcacagctcatctccccgttgaccacggcccccatggctggctgcctgtcattttattaccagatccagcaggggaatgacaatgtcttttccctttacactcgggatgtggctggcctttacgaggaaatctggaaagcagacaggccagggaatgctgcctggaaccttgcggaggtcgagttcaatgctccttaccccatggaggttatttttgaagttgctttcaatggtcccaagggaggttatgttgccctggatgatatttcattctctcctggttcactgccagaatcagaccgaacttctgttcacgtgccgtggaagccgttgcaatttgagccagatctctggcatttttcccagcattaagcaagggccggctgggcccggtggaattaaaccactgtttcgcgtgggaccccttacggtagggttccttgccccaggtgcttcccccgggtctgggggctggcccccacggaaggtggggccca

SEQ ID NO: 40602 - DNA, 1384 bp, Homo sapiens
acccacatacgattcactactgaatcagcctttctggatggaaacctgggaatctgtatttataacaagcagtcagatgattcttaggcattcttaagtttgaatacattgggagaggtgggtcataggatcacaactataccttttccttatccagcctattttacaatgccataacattcttccttaagtccttataattacattattctaaatcctattttctcctttctttcttcaaggaagttaaaggtttgaatttggtagtcttacaaatggaatagtctgtcatttgttgtggctcatttatttactcattcatgccattcaacacatacttactgagggtctgctacatgccaggcactatcctagatactgggagtacagcagtaaacaaaacagacaataacaggagctcttgctctgatgaggaaatgattaaaaaatgaagtaagaatttaaaatatatgtattatgtcaggtaagtaccatggagaaaaacagagaagaagagttgcaattttaattatggcagagaagaagagtgttgctggcaaggtgacattttagcaaagctttgaacaaagtgaagcaaagagtagtgcatctgtctggtaatgagcattccaggcagagggaatgcaagtgtggtagcactgagacaggaacctgtaagcattcctgggccaggcagggaaaacagaggccagagtgggtagagtggaatgagtgaagggatggtggcaggagatgctggcagaaaagtagcaggactaggagagaggagtggtccaggggaaccagattctaaagccagtcaacaaaaccccaatttgagaatttactagataccattctaatttcagaatcctcctatcctgtgttataatccaaatatgtcctactgacagtgaatgaaggaaatgtctataagctctcaacctcttcctctttaaaaagcgagctgccagcgctgtttcataggtgccgtgagtcgaacagaatattttggtcccttagacttatcagttctcactaaacctggcgtttttttaagtgtggtatttgaactaaaggaaataggctcattcttagattgtggtaattaaggttatgacattatgtaaataatcatgaaatgattattttaccatgtgagttttgggaaacttagattcttaaagggaaagcctttgatttgggtctctctgtgttccagtctcctttgacttaagcatctttatgtttcagctgacttctcccttagcatttggattatctgtcatatgcgtcctaagccttttgttttttaaagagaaagcaatatgttaattgaattggatcctaaccaataataggggatacttgtgtaaaaaagaaa

SEQ ID NO: 40603 - DNA, 305 bp, Homo sapiens
atgagagatctaatagtaattactgaacagttaatgtctttgtccctttattttaatggcactatcaattttaaagatgaaagtttgaatgaaaactttaggaaactttagttgtaggtactcagccaaagtagaattactgtgcttaggagcttcaaagaaaataattcactgaaacttatgtatatatgcttttttttttttttttttccatgagacggaatctcgctctgtcgcccaggctggagtgcagtggcacaatctcagctcactgcaagctctgcctcccaggttccagcgattct

SEQ ID NO: 40604 - DNA, 1033 bp, Homo sapiens
gcttttccgcgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccaggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgaaaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgttcaggccactgaatgggtaggagcaaccactgactggtcttaagctgttcttgcataggctcttaagcagcatggaaaaatggttgatggaaaataaacatcagtttcta

SEQ ID NO: 40605 - DNA, 329 bp, Homo sapiens
tcatttaggaggagatacaaattgaaactccagagctctgaaaaaggaagggttttcaatctcttaaactgtgcaagaagtgaaacaagtaattaccatgtctttatattaaccccagtcaggagcttgttctctctacttttgccagtcagttcctgccacacattaactttttcctgggagccttcaactactcctccaggtcctcaccagatgtgaaagttatggtatctgtgcttatacagtttttcatagtcactgccgctttagcattttatttcttccttgtgttagagtgagttgtttgatcttctctttattaaattctt

SEQ ID NO: 40606 - DNA, 623 bp, Homo sapiens
taaatgcacctgaactgtcaaagtgctaaaagcaggcaatccagaaatgtctggaggtaggaatcacagctgcaagaggcacttcctggttaacctcgccctccgacctctagttggagccacccctttggatcctacttcagcctttctggagtcagtggctcacaggtttcctgagacaaagagaagaggcttgagactattattacagatcagtcgtctttagaagcaaagttggttcgtggattgaattttcaaccttacagtaccaattataaatcctgaggcattctatcagttaagacaacttagaatatttgatcccattcagaactttttcatttgttttaaagcaggaaaagtaaaggaagtcaatgtaataacttttcttctttaaaatgtggatcatagtcctcttggggatgttgttcatttaatattaacattttttaagcttgccatgtatcgtgggtgtatctgtttggtttcctttggtaactgcattttgccatgacccttgataccagctctactgctacagccctaggctaggccaccgtcatctgtggcctggaccctttcagtcctaactggttgccgtgtctcctttcttagcccccaac

SEQ ID NO: 40607 - DNA, 524 bp, Homo sapiens
tttcctttggttttcctcctcaatctaggcattcctaagagttgtcttttatttcttcttagtagttaattctgggtaaatagttaataattctttataagactccctatttaaattgctgtatggatttcattttctgtccagaccctggctgctacagagatcactatctggacagtaggtatgcttcttgcaacttacatctaagcttttttcaacagccagagataggaaatgtaatacatttatctatatgcataggtataatgcacacatttatacatacctctaatcatttgcaaacctgcatatatatatgtatatgtgcacgtgtattatatagatatacatatattttagaattgtttataatacctttagtgaaacaaaattttatatgttcaattatatatttagttctctttgtactctcctcccacctcctggttttgggtttctggtcttgactagaaatgtctcctaatgcctacctgttttacaagatgattattatagtactagtt

SEQ ID NO: 40608 - DNA, 481 bp, Homo sapiens
tttgtgttctgttccctattacatgcctaaggcttcagagagctgatagccttcacttcctgccagcccccagcccatggaactgcgtaggaatctgcccatcctcgccctggagggcagaggaccgtaattacttacccaggatagcctgaccactaataaccataatcagccttagagttcaaggaagaatttcaactccagcattataagggagtgctccatctaaaaaatagatgcctttgacctttgacagtcagccgttaattttatttaaaagtaaaaaaagcttgggttatcagtcccattaactgcctttttacctgttatgtgctggtttcaaaaggtatggaagggccaggcatggtggctcatgcctgtaatcccagcattttaggaggccaaggtgggagcatccttgagtccagagaccaacccgggcaacatagggagaccctatccctaaagaaatacaatatga

SEQ ID NO: 40609 - DNA, 427 bp, Homo sapiens
tttgtgttctgttccctattacatgcctaaggcttcagagagctgatagccttcacttcctgccagcccccagcccatggaactgcgtaggaatctgcccatcctcgccctggagggcagaggaccgtaattacttacccaggatagcctgaccactaataaccataatcagccttagagttcaaggaagaatttcaactccagcctgggcggcagagcgagactctctgtctcaaaaaaaaaaaaaaaaaaaaaaaaaaggctcccaatcttgagccaggcgcagccgtgcacacctacctattgtcccagctactcaggagactgaggcaggatgattgcccaggagttcagggcttcagtgcacgttgatcatgtctatgaatgaccactgctctcctgcctaggcaacatagcgagatctcta

SEQ ID NO: 40610 - DNA, 977 bp, Homo sapiens
ggacggaagcgcagagcacggaccccgccccctcgcggccccgctcgtgacgtcgcggggggcgccggcctccgcccggccccgaggggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40611 - DNA, 1854 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40612 - DNA, 1937 bp, Homo sapiens
  misc_feature (1907)..(1907): n is a, c, g, or t
  misc_feature (1910)..(1910): n is a, c, g, or t
  misc_feature (1928)..(1928): n is a, c, g, or t
  misc_feature (1931)..(1931): n is a, c, g, or t
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccaaaaaaaaaaaaaaaaaacaaaacaaaaaaaaaaaaaaaaaaaaaaaaaaaaanaanaaaaaaaaaaaaaaaaanaanaaaaag

SEQ ID NO: 40613 - DNA, 3224 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcagtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctgtcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgccca

SEQ ID NO: 40614 - DNA, 1508 bp, Homo sapiens
tccaggacttgtacaaccatagaatgacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40615 - DNA, 1901 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccaaaaaacacaaaaaaaacacaaacaacacaacacaccaacacaagaaa

SEQ ID NO: 40616 - DNA, 1843 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggagggggccgcgcgggggatcct

SEQ ID NO: 40617 - DNA, 935 bp, Homo sapiens
  misc_feature (11)..(11): n is a, c, g, or t
ctgtacggtcngaatcccgggatcgccgcctccgcccggcccgagggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40618 - DNA, 2398 bp, Homo sapiens
atcctcagggaacaagcttcaattgaatgaaactggcttgaccacagaggaatctgggggactttctgagcttcgcggacttgtgccgcctcctgactttaagctggctctggaggaggaggaagtggaggtatctcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcagtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctgtcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgccca

SEQ ID NO: 40619 - DNA, 2387 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgctgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctgtcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgccca

SEQ ID NO: 40620 - DNA, 1719 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcgctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40621 - DNA, 1624 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40622 - DNA, 1813 bp, Homo sapiens
tgccctcatccagtggcatgccctgatccacctggtatgaaaataacagggtccccctgtcccttcagttgctccctagatgtggagagccctctccctcatggaggctccttctatagcccttggactggattaacatgtcctcctcctcctctccctgtacccctccctaggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcagtgaggttctttgctccagtcctgcgggagcagggaatggggtgggggtgggggttgtaaccggggtagagcagatccttggacttttcctcaaagactgctgcttctgagtccccgagaacctcttcaaccacagctctcccttagggactgggaacaatttgacaccgtcagcattcaatatttttctaattactttaacttttttattataaaatagttaacacttatgtagaaaagtccaatagtataaaaggacagcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctgtcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgccca

SEQ ID NO: 40623 - DNA, 1240 bp, Homo sapiens
aatttcccccgcgcggaattgagaacaggctcttggcaaattattataaagtggatacttataaataccactgagtagaatattaccagctgtccagaaaccccccatggtcccttccttcctgacaatgccctctctctccctagaaattactgtcctgctttataatgtattgccatgtatgtattcctaaataatatagtttggttttacttatttttgaaactatgtagacagaatcatacacattcttttgtggctgacttctttcaagcaacattgtgattttaagactcataactagttcacatccaagcatttgggtaacaatggtgagttaagagggttcacatttgatgatttgtcctgaatatgaaccatgtttgtcttgcttttgtcctgaaattccaatacccagttttatgatggaaattttgtaaaattcaacttgaaccgctcagaagagtctaactgatgatactcatttactggggacatagtatgtgcccaagaacttgacatgcaccttctgtcttccatttagtcatcgttacctttagaaaaagctgattccgttaacaagatctttggagggaatcagcttcacaaacgtagcagtgggtgggggtcatgttggttaaccagttcacacatcagctcactaaaggaaaaaatatttctgcaaaaaatcttcacttgtcagaggggggtgcatgaaatttgagagccatgtgttatgcatccagctcttgaactggtctcagcttcagctggctgcagtgccctaggaagttactatgggaaaagtggaaatagttgaggcccagggaactgatcaggccagaggaagtggaagctcaagatcaactgtgcttattttgctgatggctgggcctaaatgccccaaccacctacttgggacaggaaatgacaggaccctgtcaaccttggactgggaaaggagggcttcctggcccctgacagaccctggggtcctgaggctaccttagttgggattaaatgcccgtattggtctctagctgtcactccctctgctccttcctcaatttctgcacacatctcagagcttcctctagcagctcttcgacctgttttgttgttttattttctttctccccaggtgtgaatcaacttcttgggccttggctctgagttggaaaaggttttagaaaaagtgaagagctggaatgtgggggaaaataaaaagcttttttgccca

SEQ ID NO: 40624 - DNA, 1953 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcagacagaatcatacacattcttttgtggctgacttctttcaagcaacattgtgattttaagactcataactagttcacatccaagcatttgggtaacaatggtgtgaatcaacttcttgggccttggctctgagttggaaaaggttttagaaaaagtgaagagctggaatgtgggggaaaataaaaagcttttttgccca

SEQ ID NO: 40625 - DNA, 1028 bp, Homo sapiens
atcctcagggaacaagcttcaattgaatgaaactggcttgaccacagaggaatctgggggactttctgagcttcgcggacttgtgccgcctcctgactttaagctggctctggaggaggaggaagtggaggtatctcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40626 - DNA, 2034 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacagaagagaagcaggaaggagccctagaatgggtgagggatgtgatagagatctggagccaagaaggccgtatcaggtgatgcaatgatggttcatcggggatggagctggatctgggtggcaggtcaggctagcagggtgaggagctgcttatgtggtttcgtcatgactgtgaggcttctctgcgtgatgatcactgagtatggtgcgttacaggcacgggccgggagatcccacatggtctaaacgcgggtctgagggcattggaactagatacacgacgggtatctcaggtggtgaatcagcttgttgggcttggatctgagtggaaaaggtaagaaaaggtgaaagc

SEQ ID NO: 40627 - DNA, 1801 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggtaagagcctcagatgggtcgccagggttttgtagactgcctgctgactactgtatcttgaaggtccctggaaacaattctaccttgtagaaaaagcacaggttttataaccctgccttgggggctgtgtgacgtagaacaagtgtctaaacatctctgagtgtcagcatcctcatctgtaaaacagaaaacatgaccctatctcttaattccatca

SEQ ID NO: 40628 - DNA, 1697 bp, Homo sapiens
ggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttagctgcacagtggagttcttctccagagtcttcccttgtctgggctctggctggaactattcctcagccaaatcctcgccccagaacagtgcttcctgtttctccagctaagaagtctccctttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttgggaagtcctttgtcttctctgagctttcttttctctttgcgtaaaagcggtgctcttgtcccattctccctccctgtcttccagcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40629 - DNA, 620 bp, Homo sapiens
tctgcatcgttacgcggaatctgtgggctgtgacgtacttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgccca

SEQ ID NO: 40630 - DNA, 2049 bp, Homo sapiens
gccgccgcactgctctgtgggacgcggcgacccctctcccgcggcggccgggaccccgcgcccaccgcgtctggagcccacctggcggccccactggctacatttccgacctggaccccggccggctgcgggaaacactcggcgtctcggctgtcaccgaacctgtgcagttgccgcggggggagtcgtgcgtgtcagatttaggccaggaagcggaagtcgccagcagcgagagtttaacctctgtgggcgcagagggttgcggggattcagcgcccgggaccgtggatctgtgcagggagtcataggtgtgtgtgacatcagtggtggaacattttggctcgttttcacaattcagtcattatcctttctgctttcctcctggaagcattaaggttgaagttttcttctaaagatcaaagttttgatttgttatattagttcggatttgtttgatttttgtttgtgttcggtttcaagtgctgatttgtaacttttctccccccccccacacacgccttttgacccctgaattatttaaaagtccattgttggagtggcaaacatcctccgagactcaaagggcaaggccatgggcgctttattccggctgctgctccaggaacgtgggaaagcagcggagttttattctaggggaaggaaacaaaggcggccgagtgccagctgcacgtttggtgggatttggtcatcaggggtggacatgctgcccaatggagctgtcggcagtttgacccagcttggtccgtcgcgtcctgttctaggaatcgattattcaaagaaggaatttagagggactgcagaaaatgttacaggtcttaacaccattttgcatttccgcaaacgaacaagaagttaatccctgtgttagtgatttctaagcccatttgccttgtggcccaagaacgttgagtttgaaatttgatgaaacttgccttaaggctcaagtacgaggccagctttcaaaaatggttttgtgccttgattgaaaacactgtatcttctagttgttggatttatcgtactctgcggctctattggttcaagcttgtgcgttgggccttttaaaatgtgtgtttcctgataattcccttcagcttgtcaactgggggtgatgtggcagggagaaagagagagaggagagagagagactgtactggcaggttttccttgtgctattcaatttttgcttcctatgttttgaagttttattattaactgcaggtttcattactgaatagatatagccaaattccttcccccaaaagattataaagtttcctagtcctaccagcaaaatcattaagttcattaaggcaaatcccctccagcgctggatgttgatgctgtctttaattttgtatttttctgactactttgtgcaattgaggattgttttggtctattggccatttggcttttctcttttgcaaatgttcatatcctttgtccagttttctttagggtgatttttccttttcgtatcaatttgtaaacagtgtacaaattacattgtacattagggatattaacagtctgtcagttacactgtacattagggatattacattagagatattaacatctttgtccattaaggatattaaccatctgtcagttacattgcagtatttttccctaaactctttttgtcttttgcattttatgtttttttaaatgtgcaattagaaaaattttatatgggctgggcacagtaatcccagcacccatctctactaaaaataaaaaaaaaaatagccaggcgtggtatctcaactaaaaaaaaaaaaaaaaattggccgggcatggtgttgggcgcttgtaatcccagttactcgggaggttgaggcaggagaatcgcttgaacttgggaagtggagattgcagtgagctgagctcgggccactgcactccagcctgggtgatagagcaagacttcatctcaaaaaaaaaaaagaaagaaaaattgtatgtgtaatatgtaactagtgaaatgtagcctctgatcagatatgtctaaactttctttta

SEQ ID NO: 40631 - DNA, 690 bp, Homo sapiens
gccgccgcactgctctgtgggacgcggcgacccctctcccgcggcggccgggaccccgcgcccaccgcgtctggagcccacctggcggccccactggctacatttccgacctggaccccggccggctgcgggaaacactcggcgtctcggctgtcaccgaacctgtgcagttgccgcggggggagtcgtgcgtgtcagatttaggccaggaagcggaagtcgccagcagcgagagtttaacctctgtgggcgcagagggttgcggggattcagcgcccgggaccgtggatctgtgcagggagtcataggtgtgtgtgacatcagtggtggaacattttggctcgttttcacaattcagtcattatcctttctgctttcctcctggaagcattaaggttgaagttttcttctaaagatcaaagttttgatttgttatattagttcggatttgtttgatttttgtttgtgttcggtttcaagtgctgatttgtaacttttctccccccccccacacacgccttttgacccctgaattatttaaaagtccattgttggagtggcaaacatcctccgagactcaaagggcaaggccatgggcgctttattccggctgctgctccagacgcgtatgaaaacagcgtagctgtgcttcattttacgtcaggaaacacctactgagcatgagcacgg

SEQ ID NO: 40632 - DNA, 556 bp, Homo sapiens
atgaatctgtccatctatccctaattgatctggactcacatatcttttttttctagtagtttagaatgcattaatacatttaattattttgattcacaaattgtcccagctttgatcagtaggagcccttttaagctggattctgtgtccttgtaacttcctctcatcctattttcttttttttttaatttcagcacttgttatttttaggcataacaagatgttcagtgctcatcttgaatttattctgctcctgccctgaaatctaccatttcttcaaggaaccctagttgctttttgtggataatggtgttaaagactatgctgcttctcagtttattgtattttagctccacatccatccttcattgctttgtcagatctccttttccagctggtatggatgagcttagtcagtagaaggtgttggaaggacactgtaggaagtagggttttgggtgtgcttccgttcctatttgctctgtgctgccagtggcatgtgtgggatgcctagtggtactcatcccctaggaaattttgttgtcagttactgcct

SEQ ID NO: 40633 - DNA, 985 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40634 - DNA, 891 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagcttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40635 - DNA, 421 bp, Homo sapiens
ggcgcggccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggttccgcattgtttggccggtctgtctctctcactcccggtatgctatgcttatgggctgtaggtctaggtctagaatgttctaagccatcctggtgagcctgtactcgtcgcaactggattcacacagagagatgaccgtttaaatcccacccgtgtgcgatccagagactatcactggtcgttactagtatcttaatatcctatcatcatacctattgtcacacgcgcatctctcagtcatctgccaagctctacatctagcggtccaacttccttcgtc

SEQ ID NO: 40636 - DNA, 1487 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactctatgtaccagataagtttgcctctttagcaatctcagtagaagacaatcaggtatttatttcttttttgtctctctccgatttcttcacataacctaactgaaagaccataagtgagaaaggcagagaatcatcacagatctggaaagttcgggcttatttgagaactaaggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40637 - DNA, 1717 bp, Homo sapiens
ggcgcggccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggtccgggatcgcgtggccgggcggccgggcgcactcccgggattccaggcttccggggtggcgggcgaggcccagaaagcaccaggccacccggccgcgccggcacccgccgcgtcctgcttgacagaggctgatggacgtgtatttctccacggtgtgggccgcggtgctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactctatgtaccagataagtttgcctctttagcaatctcagtagaagacaatcaggtatttatttcttttttgtctctctccgatttcttcacataacctaactgaaagaccataagtgagaaaggcagagaatcatcacagatctggaaagttcgggcttatttgagaactaaggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40638 - DNA, 1475 bp, Homo sapiens
caggctgtacggcccgggatgtaggatcgcgccgcacgtggtgcttgtcttgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactctatgtaccagataagtttgcctctttagcaatctcagtagaagacaatcaggtatttatttcttttttgtctctctccgatttcttcacataacctaactgaaagaccataagtgagaaaggcagagaatcatcacagatctggaaagttcgggcttatttgagaactaaggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40639 - DNA, 2633 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagattttttttttaattcggccttgtccttcctaggttctctattgagatgagaaagcctcattatgctgacattttccacgccacattaaatagttaaaaaggatgcagcctggagccagagagcagaaagctgggctggttctgaagcttcttccatacttaagttgcctccaagcagtttgtgaaagtatcagatcttggtatcctggtgattgattcacctaatataaatatatttgtgtcatgaacctcttatcccgttgctggagttgtaatctccatcatctagaaaacgtggtctggtgctattcttttccaagcagtaccttgaagttccatttttggttcatgagtagctatagaacgcaaggtgatacatctttggtgtttgccagagaagttggcagccccacccctcctaccagcctttgcactcttcaaatttaaaaaggagctacttatcaaccccaggcccttctggtcttagaggaaggactgggccaacaaagagcaccatgggagaatggcagtggtggcatttagtgaagacaatttagtatgaatgtctgcaaaagatttttttgatagcgttgagtgtctgaaagtcccattatttttcttttttctttttccccagtaacactttctagctccacggataaggaatcactgaacctagtagttcttagacagcttggtttgagaatccttttgcggttaaaaattagggactgagccaggcgcagtagcatgcgcctgtagtcctagccacattggaggctgaggtaggaggatcccttgagtccacaagtttgagttcagccagagaccctatctcactatatatatgtatctcaaagacttcaatgggtttttgcttacatgggccagtaattgttgaacaaccagctatttgagtttgagctatctgcatgacacctctaaacacagagttgggaatagatgtgcacaatcagctctggggagctggtgcaatcctgccctagcacaccactggtttaagatagatatatcatatagatatttaccatttaccatattggaaagtaaaatggagaaaaatttaaaacacaagatacatgagcacacattccattagctattaaggtgatggacacggtgtccaaatgacacggtgtcatttaacttctggaaaacaacactgtgtactgagaacaagagaaagacaaatgacttttttaaattaagtttttaatttacaattgatgcataattttactttaaaaaaataagtgtgcaatttggtaaactttgacatatacagctataaaccactccaatcaagataacatatttaccacccccaacagtttccatgtgctgtattataatccctctggctagtcctttgtcaatcactgataaattttattactatagattagcttgcattttctaaaattatataaaaatgaaatcatgccattagtgctttttctgtatgtcttctttcactcaaaatcacttggaactcaaaattacttctttcactcaaaatcactcaaaattacatactctgtatgtcttctttcactcaaaattacttctttcatttttagacggaagcatttagacctcaaaattacttggagattcatctggtatgt

SEQ ID NO: 40640 - DNA, 1443 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctatgtaccagataagtttgcctctttagcaatctcagtagaagacaatcaggtatttatttcttttttgtctctctccgatttcttcacataacctaactgaaagaccataagtgagaaaggcagagaatcatcacagatctggaaagttcgggcttatttgagaactaaggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40641 - DNA, 1228 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagaaaaaaaaacaaaaagcactcagactaagccaaaaaaaataagataaccatgaaaaacgacgaacaacaccaaagccaccagcagccgacccgaacaaacaggcccacggcccgccatagacacccccactccacgagaacaggcgcccaaaccaacccacaccaccccacacaccccagagggccgaaccaacacagccagcagcccgcccgacccacgcgcacaacgcccgcacgggccaca

SEQ ID NO: 40642 - DNA, 829 bp, Homo sapiens
acaatcgagctcgcaccccacgcagattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40643 - DNA, 816 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40644 - DNA, 2637 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagagctgcagaatgtaggtatatacaggagatataataaattgacaaaatgaaaaaaaaaaattgggaagtaaattaagagaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagattttttttttaattcggccttgtccttcctaggttctctattgagatgagaaagcctcattatgctgacattttccacgccacattaaatagttaaaaaggatgcagcctggagccagagagcagaaagctgggctggttctgaagcttcttccatacttaagttgcctccaagcagtttgtgaaagtatcagatcttggtatcctggtgattgattcacctaatataaatatatttgtgtcatgaacctcttatcccgttgctggagttgtaatctccatcatctagaaaacgtggtctggtgctattcttttccaagcagtaccttgaagttccatttttggttcatgagtagctatagaacgcaaggtgatacatctttggtgtttgccagagaagttggcagccccacccctcctaccagcctttgcactcttcaaatttaaaaaggagctacttatcaaccccaggcccttctggtcttagaggaaggactgggccaacaaagagcaccatgggagaatggcagtggtggcatttagtgaagacaatttagtatgaatgtctgcaaaagatttttttgatagcgttgagtgtctgaaagtcccattatttttcttttttctttttccccagtaacactttctagctccacggataaggaatcactgaacctagtagttcttagacagcttggtttgagaatccttttgcggttaaaaattagggactgagccaggcgcagtagcatgcgcctgtagtcctagccacattggaggctgaggtaggaggatcccttgagtccacaagtttgagttcagccagagaccctatctcactatatatatgtatctcaaagacttcaatgggtttttgcttacatgggccagtaattgttgaacaaccagctatttgagtttgagctatctgcatgacacctctaaacacagagttgggaatagatgtgcacaatcagctctggggagctggtgcaatcctgccctagcacaccactggtttaagatagatatatcatatagatatttaccatttaccatattggaaagtaaaatggagaaaaatttaaaacacaagatacatgagcacacattccattagctattaaggtgatggacacggtgtccaaatgacacggtgtcatttaacttctggaaaacaacactgtgtactgagaacaagagaaagacaaatgacttttttaaattaagtttttaatttacaattgatgcataattttactttaaaaaaataagtgtgcaatttggtaaactttgacatatacagctataaaccactccaatcaagataacatatttaccacccccaacagtttccatgtgctgtattataatccctctggctagtcctttgtcaatcactgataaattttattactatagattagcttgcattttctaaaattatataaaaatgaaatcatgccattagtgctttttctgtatgtcttctttcactcaaaatcacttggaactcaaaattacttctttcactcaaaatcactcaaaattacatactctgtatgtcttctttcactcaaaattacttctttcatttttagacggaagcatttagacctcaaaattacttggagattcatctggtatgt

SEQ ID NO: 40645 - DNA, 2620 bp, Homo sapiens
cgaggctgtcgccctggggtaagatgtcgcgccgagcgttgtgcctttatgctagtcgtgacctctatagattgtccacatcgcagctgctaatacttcacgcaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagagctgcagaatgtaggtatatacaggagatataataaattgacaaaatgaaaaaaaaaaattgggaagtaaattaagagaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagattttttttttaattcggccttgtccttcctaggttctctattgagatgagaaagcctcattatgctgacattttccacgccacattaaatagttaaaaaggatgcagcctggagccagagagcagaaagctgggctggttctgaagcttcttccatacttaagttgcctccaagcagtttgtgaaagtatcagatcttggtatcctggtgattgattcacctaatataaatatatttgtgtcatgaacctcttatcccgttgctggagttgtaatctccatcatctagaaaacgtggtctggtgctattcttttccaagcagtaccttgaagttccatttttggttcatgagtagctatagaacgcaaggtgatacatctttggtgtttgccagagaagttggcagccccacccctcctaccagcctttgcactcttcaaatttaaaaaggagctacttatcaaccccaggcccttctggtcttagaggaaggactgggccaacaaagagcaccatgggagaatggcagtggtggcatttagtgaagacaatttagtatgaatgtctgcaaaagatttttttgatagcgttgagtgtctgaaagtcccattatttttcttttttctttttccccagtaacactttctagctccacggataaggaatcactgaacctagtagttcttagacagcttggtttgagaatccttttgcggttaaaaattagggactgagccaggcgcagtagcatgcgcctgtagtcctagccacattggaggctgaggtaggaggatcccttgagtccacaagtttgagttcagccagagaccctatctcactatatatatgtatctcaaagacttcaatgggtttttgcttacatgggccagtaattgttgaacaaccagctatttgagtttgagctatctgcatgacacctctaaacacagagttgggaatagatgtgcacaatcagctctggggagctggtgcaatcctgccctagcacaccactggtttaagatagatatatcatatagatatttaccatttaccatattggaaagtaaaatggagaaaaatttaaaacacaagatacatgagcacacattccattagctattaaggtgatggacacggtgtccaaatgacacggtgtcatttaacttctggaaaacaacactgtgtactgagaacaagagaaagacaaatgacttttttaaattaagtttttaatttacaattgatgcataattttactttaaaaaaataagtgtgcaatttggtaaactttgacatatacagctataaaccactccaatcaagataacatatttaccacccccaacagtttccatgtgctgtattataatccctctggctagtcctttgtcaatcactgataaattttattactatagattagcttgcattttctaaaattatataaaaatgaaatcatgccattagtgctttttctgtatgtcttctttcactcaaaatcacttggaactcaaaattacttctttcactcaaaatcactcaaaattacatactctgtatgtcttctttcactcaaaattacttctttcatttttagacggaagcatttagacctcaaaattacttggagattcatctggtatgt

SEQ ID NO: 40646 - DNA, 1736 bp, Homo sapiens
ggcgcggccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggtccgggatcgcgtggccgggcggccgggcgcactcccgggattccaggcttccggggtggcgggcgaggcccagaaagcaccaggccacccggccgcgccggcacccgccgcgtcctgcttgacagaggctgatggacgtgtatttctccacggtgtgggccgcggtgctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggtaacttcctacccacaaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactctatgtaccagataagtttgcctctttagcaatctcagtagaagacaatcaggtatttatttcttttttgtctctctccgatttcttcacataacctaactgaaagaccataagtgagaaaggcagagaatcatcacagatctggaaagttcgggcttatttgagaactaaggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40647 - DNA, 1506 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggtaacttcctacccacaaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactctatgtaccagataagtttgcctctttagcaatctcagtagaagacaatcaggtatttatttcttttttgtctctctccgatttcttcacataacctaactgaaagaccataagtgagaaaggcagagaatcatcacagatctggaaagttcgggcttatttgagaactaaggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40648 - DNA, 1215 bp, Homo sapiens
ggcgcggccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggtccgggatcgcgtggccgggcggccgggcgcactcccgggattccaggcttccggggtggcgggcgaggcccagaaagcaccaggccacccggccgcgccggcacccgccgcgtcctgcttgacagaggctgatggacgtgtatttctccacggtgtgggccgcggtgctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40649 - DNA, 1004 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggtaacttcctacccacaaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40650 - DNA, 941 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaaga

SEQ ID NO: 40651 - DNA, 824 bp, Homo sapiens
  misc_feature (2)..(3): n is a, c, g, or t
gnngcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagaacaccgaaagagtggttggaaagaaccaaacaaaattcttgggaaaaaaaaaaagagcccattatgtcgtagtatggagagaaaaaaccaaagccctaaagtttatgtttctaatgtgtcacagaataggacgatatgattctacaacataatcaactccctattaaattctttaatgaaga

SEQ ID NO: 40652 - DNA, 529 bp, Homo sapiens
tatgagataagtccctaccaagtaggaccaggttcaaatgtttttgaattaatgaacaatctatataggtaaatatcatcccatttacagatatggaaactgaggttcatgggattaaataatgtgtttcaaaggggaagtagttatttttaatttcaaaatcagtttttaagtattcatggtaacagtagcttcctttcccccactgtattgttagaatgaaacaaaaaaaattttttggagacagggttttacccaggctagagttcaatggcataatcgtaggtcactgttgactccaactcctgggctcaagctatcctcttgcctcagcctccaagtaactaggactacaggtatgtgccaagatgcctagctattttttttttcctatagcgatgggatctcactgtgttgcctaggctggtcttgaactccaggcctcaagtgatcctccctcagcctgtcaaagtgctgggattacaggtgtgggccattgtgcctgacactgaaatgaaaaagttaacca

SEQ ID NO: 40653 - DNA, 346 bp, Homo sapiens
ggactccagatttcatcagagccccagtgatgtcctttgactgtcacacatgttgaggctgtttgcaactgactgctctactgagataccccggacacagctggaggctgaagcatttcctcccagtcacagcagctcggagcctccctgagaattccctagttatatctgcctgtgtagtcacttgtgcactgatccatcctgggtttgacaaagcaattccaaaatgatgtcccgagttcacaccatacatggtttctgccagagacagtttacagatcttcagactgaagaaggccgtactatttagtacccacaaagacattaatcctctttctgtattagc

SEQ ID NO: 40654 - DNA, 297 bp, Homo sapiens
aactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcag

SEQ ID NO: 40655 - DNA, 904 bp, Homo sapiens
caataagtcactccggttctggcatttccctatcttatcctgcatacccctcctcctggctctgagtcctgaggagtgagattgcagtttttgacccatgttcttactgagaagtgggctgtcatgcaggtataatataaaatccagaagctgctgtcagaattatgtgagaattgggaggtgacagcatgggccaattttctgaatctctagggtgctttgatgcttaagaagtctttctgggctccctgagatttgaaacctcttgttttatctgtcctttcactctggttcttcctttcctttcttggggacttcatgcttctcaaatatttgttaagtgggtgcttatatgggaccttagaaagcaaccagctaggcatgcacttggaaagggacaggaggactgagaacaagactaaacatttctgtgagattgagcagcaggagagctttgcttctttactggtgtcagtatgtgcctgcagctcctgggctgcctttactcgagtgagatccatttacaagactcctgactcttctactccactttattacaaaagatgttgatgctcgttttaaaaacaatttaaactacaaacatgaataaaggtatttatctccccaccagtccccctcattctcccttccctcctgttcttagactggtttcccctcccagtagtttaggttgtggggcaagtgtgtgtagctctgcatcagtgtcttaaacaaaatgagtgtgtcgcggatgcgcagctcggccacttcctgttttcttcggctgtatgtcacggccatcctgccatggcaccatgtctgtgccacctgctgctcttgggcatctgcagagaattccatgacatggatcttgaggtagtcttcttcagctttttctacttca

SEQ ID NO: 40656 - DNA, 316 bp, Homo sapiens
gaaaggcagttttgtcctctccttgttagctcacttggctgcgttgggtctcaaataataacgctttcatatccgtgcaaatgccctcatcccaggcagtttagcctacttttcatcatcaaccagtgggagtcttgtgggccaatcctgtctgaattcaaagcagaagggtgaagtctcccttcccctaacagcctctcgcagctctcaacttcatcagtaacagcttgaaggagtgtagctggacagatagaaaacggaagcaatgattcctaggtgggagactcatagaccagaagggacaggctaggaaaga

SEQ ID NO: 40657 - DNA, 335 bp, Homo sapiens
tggaatgttcacactcactttttccacctaacaaatttcccaagagctttcagctgagcaggcttagccccagagagacctagactcatatcttagctctgctacttagtagcttatcacctcaaggtctcatttgtaaaatggacatcaaaagaaggcttactaggattgttaaaaaaaaaaaaaagttgactgagataattcatatatacttgcctatgtacagctcagctgctatctgtgtctagggtctgccaccatgaatattaactattatttttacagtagatattcttttatctgatataaaatggcctggtagtaggtaggctaat

SEQ ID NO: 40658 - DNA, 454 bp, Homo sapiens
tcatttgcaacaacggatggatctggaggacagtgtgttaactaaaataagccaggcatagaaagcaaatactgtatgatctcattcatctgtggaatcttaaaaagctgaactcatacgtagagtatagagtggtagttaccagggccaggggccggggtgggggatgctggtgaaaggatgcacagcctgagctggcaggagggtgaggtcgggagcttggctatgcatgacggtgaccacagttgacaacaatgtattgcattcttaaaaaatactaagagagtggattttaagcattctcgccacaaaagatgacaagtatgtgaagtaatgcgtgttaaattagctcgacgttgctgttccacgatgtatacatattttaaagcatcatgttgtacacaataaatatatacggcttcatttgtcaattaaaacatgaattaaaaaagaa

SEQ ID NO: 40659 - DNA, 342 bp, Homo sapiens
cagcaaattactcagagataatatcataaagcccccacatttgtctggaagataatgcccagagccccctcactcatcactttgtggtgaatttaaagcctctgcacctggaacagtttgttttcctgtaaccatctgtctttttaagttttttgtctgttttttcttctgtaagtttattgcagctggaatcccccctcccctctctaaaccaatgtataaaagaaaatctagcccattctttagggccgagagtatttcctgtgttagccgtctctcagtcaccagctaataaaggactcctgaattcgtctcaaagtgtggcatttctctgtaactcgt

SEQ ID NO: 40660 - DNA, 371 bp, Homo sapiens
ccttcggaggtttcccatctctgagtaaaagccatgttcttttcagcggtcatttgcagcctaatctattctggtccctgccgaagctcttgggcctcctctgctgatttcctcttctcttgttaaattgaagtcacactggcttccttgttattctttaaagcagccagctggtccaactcctcttactcagcttggaagacactttcccagatattgttatgattcactcccttgccacctccaggaatttgcttaaatgccacctcaatgaggccgccttttacaaccctatttaaaattgtaccttcctcaagtatctggtacccatttcttgcctttatttttctctgtagcacttaccatctagc

SEQ ID NO: 40661 - DNA, 401 bp, Homo sapiens
aaactcttattttaagtaaaagttccatcaggtttttacaaaaatagattttaccctagtgctcaagtcaagggggcaatggcctgcgggtttaggatttaggatgaggtgagcaggaagcatgcgtggaagccagctcatgcccctcatgcatattcacgaagggcctgcttctgtgaaacagaaccccgactggagtgcctctggatgcccatgctcagctcaggctgggtgaagctccgcctcagccaggagctccaaggagtggcaggtgggtcgggggagagagaaggaggcagagctgggtcctacaacgttcagttgtccctctgtgtgacctatgctgagggttgccagtttgcaaagcaacagtgacctatgctgaggcttgccagtttgga

SEQ ID NO: 40662 - DNA, 228 bp, Homo sapiens
cgcacgcgcacacgcacgcacacatgaacaagcacgcacatgcacgcacgcacacatgaacacgcacgcgcgtgcctcaaggccagctgcgcagtgtccacgtggagcctcctgagggcaggaccgtgccccctggctccctcgtgctgccgggccggccgcagggccgcagcggacaccgatgagggaaggacagccccgcagagagcggaagtagcgggcgcggac

SEQ ID NO: 40663 - DNA, 274 bp, Homo sapiens
ggtaagaactttggtatgaatatcacagtttctccttgtttctttggagactgcatcagatgccaactaggaactgaatgtaccaggaacacagctatccttttacccacttcacccccgcccccttagaaggaagaggaataatagtaacaatcacaattgtagcaacaaccgtgaacatttactgagaatttgttatatgccagatattctaggcgacctcacctatgactgtttctcaaattttcatagtttacaaaaagtgattactttt

SEQ ID NO: 40664 - DNA, 376 bp, Homo sapiens
catattgcaaatatgcattatgtgactcttgttgaaatagaggttcaatcaatctaatgatcttccactgtgctttctgacttgatccctaattctgaggcttattcatctgaaatattcctcactttttggggggcagaggtagaggatcatgtttttccttataaattgcctttagtaattgttcaacaaaacatttaaagacattggcactaagtagcacaaaagtgatatcactgcaactgataggaaggtatctaactagaaatcaacagtttgacggttatttttcccccaggatgtatactttaccacctcctcttataatcatagtaaaggtcgtatacctggaatttaactatttaaaaagcactat

SEQ ID NO: 40665 - DNA, 391 bp, Homo sapiens
tttcagctaacagacagcagcaaaggccatcgcctccttctgacggaatcagaaggtggaaccaggccagtgtagggtgggaccagaactgatgtctggacacacgacccgtagactgtccctgccattggagagctggggaccgcgccacaggaggctgcgtggttatcgcctgtgagccacgaagaccttcatttcctcatctgtgtttactttgtgtctcctctgaatgtgatcctatgttctgggtggtggttgtttcccgaaatggctgcatttcaaatatgctgttcttttcccatcaatagtttcttgccagctgggtgcagtggctcacgcctgtaatcccagcactttgggaggccgaggcaggtggatcatgaggtcaaga

SEQ ID NO: 40666 - DNA, 330 bp, Homo sapiens
atactaaaaagtaaatctgacaagagatatgcaagacatgtgcactggaaactataaaacattgctgaaagaaattaaagaagactcgggaggccgagatgggtggatcgcctgaggtcgggagctcaagaccagcctgaacaacatggagaaaccccgcctctattaaaaatacaaaattagtcggtcatggtggcacatgcctgtaatcccagctccgcgggaggctgaggcaggagaatcacttgaacccagcaggcggaggttgcggtgaaccaagattgcgccactgcactccagcctgggcaacaagagtgaaactccgtctca

SEQ ID NO: 40667 - DNA, 1021 bp, Homo sapiens
ccctcaaccatgagtgtagggaaagggaccaggggccccaggctttcctgtcagtaatgcagaagttcctcagatttagggaagggggagcagaggcataactttgattctgacaaagaggcattcagagagactgaaaggtcatttaacaaacactggaatgcttccacatactaggtgctaggagatacaaaaccatataggtcctggaagggaggattgattttttcattttggtacgtagtagatattaggggcttaggaaatacacatcgaaatgaagagtgcatttgccatgttgaaccgttagccggtatcttatttccccattttaaaagttttagaatctgtggttgaggacttgtggccatcagttttccatagccaacagactgttcactactgccttcagagctccttggacctcagcgggccttctttggagatggcagagatggatttagatgtatactctactcgagccacccagagagcccacaaagtcagagatggaacagggtaaaggagtaagggtcatatgtgtgagatgccttgatttggaactttgagatttaggatgaggtggggaagggctaaagaggagcttgttcctgagccttgcttggccgaagcatttaggctcaagcgttttagaaagagtagcccttggtctgagaactcaaggaaacagctttctgatgagacgtgtagcaagcttctggttcacatccttacctgatagttcttcaaacactgcctggtctggttcacatccttacctgatagttattcaaacactgcctggaagcttctcctgagtttttgtctctaatcagctaactaacaggctgagtgagtttagttgtaagtcattaatgaagaaagcaaaggttggggccattgtcagggttgtgacctgggctagttaattacctggaactgatggtctgtgttacagagtggtggtatacttgtcaggcttagaaaagaaatcaggatgtgtatcaaaaatcatttgggg

SEQ ID NO: 40668 - DNA, 603 bp, Homo sapiens
  misc_feature (602)..(603): n is a, c, g, or t
gagaacatgttgttttccttgaagtacttgtttcttccgtaatttcatatctaatctcccagcttcacacataacagatttgcttgacaatgtcctaaaggatggggacagtcttggctttcacatgagaagagctaattagaacaactgattttactttgggagaaaccaagtttccagcatgcatctagtgataaattatgaaagctttcctcagtactcctgccctatgatccttccctcacttcattaagcctgctgcatcttgcatggatggaggtcacagatggcagagcagcttcttggatgaattgcagggtctcccaactcttcaagcagcatcctctgtgctcccactcctgtgctcatctctactcctgaactacagtgccatcttgtcatttgtctgtttcaatgtctgtttctccaactggacagtaaacccttggaaaagaagaaccaatcttatttaaatttggtatcctcagcaaccaggacagtgcctggtactttccaggtcctcattaaatgttttttggatggatggatgaatcaataaaagaaaaactccaaatgaaacagttgtggaaactaaaaaaaann

SEQ ID NO: 40669 - DNA, 395 bp, Homo sapiens
ccaataggatggatggatggattgatggatggatagacagagagagagggagaaagagagagagagagagagaggtgggaagagatttgttagggcgataggctcgtgtgattatggaggttgagaagtcccatgacaggctgtctatgagctggagaccctgggatgctggtagcttagtgcagtccaagttgaaagtccttggaactggggaagctgacagtggaactctcagtctgaggctgaagacccagagactggggggctgctggtgttaagtcctggagtccaaaggccaggtagcctggagttgttgtccgaggacaggagaggaagaatgcttgagcccaggaattcaagagcagcctgggcaacgttgtaagaccccatcttta

SEQ ID NO: 40670 - DNA, 1741 bp, Homo sapiens
gaacccgcctgtcagccagcctttcgagctaattagctcagcatacaacaaagataagtgagcctgggaagagggccccctgaggggtctttagattctgggaaatgtctgattggcagatgttaaaagggattccttggtaatccagtgcatcaatgagctgcagaaattcagcccaggactgcaagaattcaggcatgaggacactctgtacaggaggctcacacaggcagacccaagatggacagaaccttggaatctctgagacacatcattgcccaagtcttgcctcacagagatccggctctagtcttcaaagacttgaacgttgtgtcaatgttacaggaattttgggaaagcaagcagcagcagaaggctgcattcccaagtgaaggtgtggtggtctatgagtcactgccagctcctgggcctccctttgtgagttacgtgaccctcccagggggaagctgttttggcaactttcagtgctgcttaagtagagccgaggccaggcgggatgcagctaaagtggccctgatcaactccctcttcaatgagctgccctctcgcaggatcaccaaggaattcattatggaaagtgttcaggaagcagtagcctccaccagcggcaccttagatgatgcagatgaccccagcaccagtgttggggcctatcactacatgctggagtcaaacatggggaagactatgctggagtttcaggagctgatgaccattttccaactattgcactggaatggaagcctaaaagcccttcgtgaaacaaagtgttcccgacaggaagtcatctcctactattctcagtattctctagatgaaaagatgcgcagccacatggccctggactggatcatgaaggagcgggactcaccaggaattgtctctcaagagctacgaatggccctgaggcagttggaggaagccaggaaagcaggacaagaactacggttttataaagaaaagaaagaaatattgagcttagccctgactcagatctgcagtgaccctgacacttcctcacccagtgatgatcagctgagccttacggccctgtgtggctatcactagcaaggccaagccccgggtaccctcagtgatggcagaggccagattaacattaggaatctcagtgcagaggtcctcagaggctccagcatctctagtactacctgaaggctctcctaaccctctccacacattccatttacagagtatgagagtcgtaggacccttacaagacccaacaagccactcgatgcatttttctatcacattctcaatagttccagctcaggatgaaaggatagacacaaaattgtttgaaaaacattttccaggcctggctccaacctaaagcctgactgtcacgtgccttgcttgattttatatatattgtttcaagaatagtccaatatagcattccccaaatgaacagcagccagaattaggtgaagtagcatgatagcagtgtttaaaaatacttaggattaaataaataatatggattgttttaaaaaatatccaaggatcagagtctctttctaagctttgtaagctaagcaatagtttatgtcctactagatacactgcaaactacagtggggattttatctggacatcccaccatcaaagatcttgaaatagtaatagtatgaaaatactagataaaattaatgtttaaaatgtttttgtaacaataatttttaaaacccacactctt

SEQ ID NO: 40671 - DNA, 1534 bp, Homo sapiens
gaacccgcctgtcagccagcctttcgagctaattagctcagcatacaacaaagataagtgagcctgggaagagggccccctgaggggtctttagattctgggaaatgtctgattggcagatgttaaaagggattccttggtaatccagtgcatcaatgagctgcagaaattcagcccaggactgcaagaattcaggcatgaggacactctgtacaggaggctcacacaggcagacccaagatggacagaaccttggaatctctgagacacatcattgcccaagtcttgcctcacagagatccggctctagtcttcaaagacttgaacgttgtgtcaatgttacaggaattttgggaaagcaagcagcagcagaaggctgcattcccaagtgaaggtgtggtggtctatgagtcactgccagctcctgggcctccctttgtgagttacgtgaccctcccagggggaagctgttttggcaactttcagtgctgcttaagtagagccgaggccaggcgggatgcagctaaagtggccctgatcaactccctcttcaatgagctgccctctcgcaggatcaccaaggaattcattatggaaagtgttcaggaagcagtagcctccaccagcggcaccttagatgatgcagatgaccccagcaccagtgttggggcctatcactacatgctggagtcaaacatggggaagactatgctggagtttcaggagctgatgaccattttccaactattgcactggaatggaagcctaaaagcccttcgtgaaacaaagtgttcccgacaggaagtcatctcctactattctcagtattctctagatgaaaagatgcgcagccacatggccctggactggatcatgaaggagcgggactcaccaggaattgtctctcaagagctacgaatggccctgaggcagttggaggaagccaggaaagcaggacaagaactacggttttataaagaaaagaaagaaatattgagcttagccctgactcagatctgcagtgaccctgacacttcctcacccagtgatgatcagctgagccttacggccctgtgtggctatcactagcaaggccaagccccgggtaccctcagtgatggcagaggccagattaacattaggaatctcagtgcagaggtcctcagaggctccagcatctctagtactacctgaaggctctcctaaccctctccacacattccatttacagagtatgagagtcgtaggacccttacaagacccaacaagccactcgatgcatttttctatcacattctcaatagttccagctcaggatgaaaggatagacacaaaattgtttgaaaaacattttccaggcctggctccaacctaaagcctgactgtcacgtgccttgcttgattttatatatattgtttcaagaatagtccaatatagcattccccaaatgaacagcagccagaattaggtgaagtagcatgatagcagtgtttaaaaatacttaggattaaataaataatatggattgtttta

SEQ ID NO: 40672 - DNA, 323 bp, Homo sapiens
gacctcaggttatctgcctgcctcggcctcccacagtgctgggattacaggcctgagccaccatgcctgacccaaactttttcttatagttagttgatttctaaaacttaaaattgaagggagttagagataaatagtgttttttaataataccaaatagagtttttcaacacgtgtgaggcaaccaaatagaaaatatactgcctgatgtttctctttccacattgggagaggcagccgagagtggtagaaaggacctctctaacatcctcgcttattgactaaaaccataggaaatttacaggcatctctgggactcagtt

SEQ ID NO: 40673 - DNA, 154 bp, Homo sapiens
aagatttagagaattctggaggctctttgtcattgttgctacctgttttttgaaaaatcccatatcaaactccctggacttcttagggggtaatgtcacttatagtacctcagggcgagcttatggatgggcagctgccatattgaatctcggg

SEQ ID NO: 40674 - DNA, 1251 bp, Homo sapiens
gtcatggacaatatcctggagaaagtgctatgtaagctgagggataaaacaatgagtaatagtacctggccaggtgaaaagagaggaggagcatttcattccagaaagaacgttaagggaagtttaaagtaagaaggaatctagtgtcatcaataacttgaaaaaagacagttagtgtaactggagtataaaaacctcggggtggaatggtaggtctgatcatattgggccttgtaggggatgtcaggtgttgagatctttatcataacagcagtgaacaaacaaaagcattttgttttcattgtggcaagacatacgtaatgaaatttaccattttaatgatttttaagtgtacattcagtggcactaagtacattcacattgttgtgcaaccattgtaccatccatctccagaacattttcatcttcgcaaactgaaactctgtacccatgaaacagtaactccccattccctcctccctcctacccctgaaaaccactattctgtctctatgaattttactattctcaagtacaatcatatttatccttcatttgcattccaattgcaatgatttaaagaaatgtatttactataggatagcaatctttgatgactgcaacaaataatcaatggtatgtatgtgaaatttataataaaaaagatgtatggagtttataatgaaaatactggatggtgaagtgggtgatatagtggcattaacatttaacagttattagttacatggcttatatagaaaccaattatcaaagtgagaaatattgaaaagtaattcattaacaacatatagacaaagccttagcaggcacctatttggcatacaataaaagcatgtatcatgttattgttaaaaacaaaacagctctatatctatgtatcctcatcttcctgtctggtggtgtcaagtaatggtggaataatctatattgaggaatattgaggatgtctacagtttaggactagaatgtcctaaactagtctctaactagagactagtctctcagttaacagagctctaatagagtaagtcagttgtaaataatcttctataagaatgtacagttatttgtaactggaaaataattgacaattccatatcaacccaaattaatgctgaacaatattgcaaatgtcattttagttcatttatgcagtctaaatcataggttcttcttgactgcagattcagtttattaaatcctgatctatttgtaatttgctgaaatgac

SEQ ID NO: 40675 - DNA, 257 bp, Homo sapiens
caaacttccgaaatttggtggaagatacgcatctatacgtccaagaaactcaataaattcagggaggataatgtcaaagagatatacactgagacacattatagtataattgtcagaagtcaaagacagaatcttcaaagcagcaaaagataagtgactcatcacatacaagcactcctcaataagatttacaactgttttatcatcagaaactatggaagccagaaagctgtgggctaacaatatttaaagtgtcg

SEQ ID NO: 40676 - DNA, 547 bp, Homo sapiens
ataagaataagaataataaagtaggacagtccaaagtagactctaaggaaacaaggaccccgggaagttttgttgttgtgcttagttgatatatattttttgaatttttttggttattgttttattttggttattttttcctcctctcctggctatttatttgtttggtatgaatagatgttttaaataatatgaaccggaccttcaagagccttaaatagtttgtttcttggataatttattatgatcatgtgaactgtactcacgggggaaagattattttgtgaggccaagcaacctgctcagagtctatttttctacatgtccctcgtcccggctgtcagaaagcaaacctctgtccccgccatccctcccttccatctcctgcttctcagcaagtgcaaactcaaacgtgcttcatgggggtccacaaattatatttttatacacagaattgtaaattagattttttgagagatcaatacttaactgaattacatttcatttttgaaatagtgtaaaatatgaaaatatattattttaattt

SEQ ID NO: 40677 - DNA, 273 bp, Homo sapiens
taatagaatttaattacaaacatctccagtgagaaagaaagaaaaaaaaataaaagaaagcattgatcaaggggtcttcctagaacacgttttagctaattctggaaaagtttacattagttctggtaagattgggaatcatattaaaattaaatggccacctatacttttcgaactttcctaattttttatgtatgtggtagtccattatcagagagtgtttacaaatgcaaggtattcagtttatcagttataattatattttggaaactt

SEQ ID NO: 40678 - DNA, 400 bp, Homo sapiens
aggcatgagccaccgtgcccagccagcttctggctgtattttcgttttcatttttgtacgtttaaatattgaaggttaacatttaatttttatttttatttatttattttttttgagacgttgtctcactctgtcgccgaggctggagtgcagcggtgctcactgaggccttgaacccctaggctcaagagagctcccacctcaggctccgaaaatgctgggattacaggtggtgtgagataccacaccagacctagagtttttattttttaatttttaaaaaaatttttatttatttttttgagacggagtctcactcttttgctcaggctggagtgaagtggtgcaatctcggctcactgcaacctccgccccctgggttcaaacaattctcctgcct

SEQ ID NO: 40679 - DNA, 626 bp, Homo sapiens
agttgtggtatggtgacttctgtgtttatctgcaggggtgtgaatagctgtaatatccactgcacctgctgccttaacagtggagttggccaggcgcagtggctcacacctgtaatcccagcactttgggacaccaagttgggtgggtcatctgaggtcaggagtttgagaccagcctgaccaatatggtgaaaccccttctctactaaaaaaatacaaaattagccaggcatggtggtgcatgcctgtaactccagatacttgggatgctgaggcaggagaatcgcttgaatatgggaggcagagccaagatgacaccattgcactccagcctgggcaacaagagagaaggtccttctcaaaaaaaaaaaaaaaaaattcccaaaataccccaaataagctagttacctcttaggctttgtggtgcacagtgccctcctaatcatgactactgcaaaatccagtccattaaagtgtaaaatgaggccaggtgcagtggttcatgcctgtaatcccagcactttgggaggctgagttgggaggattgcttaaggccaggagtttgataccagcctgggcaacatagcaagaactccgtctctacaaaaaaataaaaagtgtaaaat

SEQ ID NO: 40680 - DNA, 435 bp, Homo sapiens
gagggatgactttctaagccacagttccttctgataacggtcttaaaagagaagcaccatgaagtgataaacacatcagtccaggaagatttagagacagcctagtagaggaggattggaaacagtgtggctgtgtccctgagggtgctggtgctaaacccacggcacagtccatatcagtcaaagcttcattctccttgtgcccacactatgctgatctgccccagtgcaacagggagacgcatatggtcaagagaatgtgtctttcacgaatagattttctccttcgaccatggtgagaagtccttgtaaagaagcatacatgaatatatggatgtgttgggcatcagctgtgcgtgtggccctcagccaggtgagtggaggaagttggaggcattcagtgttcacctccatgtgcttttcagagacatacct

SEQ ID NO: 40681 - DNA, 1043 bp, Homo sapiens
catctgtttaatagtcagtgtaagaacataggcagcatttctggtgcatactgatggaaaggcagttgtcctgtggaaaagccattatgtaattgcatgagttgtgagtgaagttaaacattttttttttagtgggtcatcattttccttgaaagaatgactgaaaggcacactgtgattattcagacttgggtatttggtagaaattttctcaaaaataaacaaaatgagcctatcccatcagagaaaataatattgacagtggaaattggaatttcaagagaaaattaaaattttggaaaacttacgtgtgccgcagcttctcactacttaaagatgtttctgatgagattggtggtgatattaacaaatatggtttaaaaaatattgtttaataaaatatgtcaacattttaaaaaactgcgtaaacccatgaatcaataatttacaaataatcaatgcatgatattgcaaagtcatgcatagaggaaaagatccatttaaagatagactagtgaattttaacacaacagaatatgaaaagttaatttataaggtttcagattccacactgcaactaacctttaagaatctgccatttcttgagttttggtgtcttatcaaggaagaacagttacaatagctgaaatggttattgaaactttccttcttttcccaactgtgtataagagtgaggccagattttcctcttgtactttagccaaaacaacatattgttacagcttgaatgtagaagaatatataaccaagctagctttattaagccagacattaaagagatttttacaaatgtaaaataattccttttttttcactatttttttgtgctggagaagacagctattttccataaaagtatgttgtttatgttaacatgtaatgggtttgttattgttatttaataacaaataaattaatataaatgtcactttacataacccatgtaaactaaagcttcttggtgttctcaacaattttacgaataaaaagggatcctgataccaaaagaattataagctact

SEQ ID NO: 40682 - DNA, 634 bp, Homo sapiens
cccaagctccgaatttggccaaacttttttttttttctcggaaaccgcgcctttgtgttggtaccgggaaatccggccattatggccgggaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgc

SEQ ID NO: 40683 - DNA, 2622 bp, Homo sapiens
agcggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacaaaaaaaaaaaa

SEQ ID NO: 40684 - DNA, 1637 bp, Homo sapiens
agcggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgc

SEQ ID NO: 40685 - DNA, 2048 bp, Homo sapiens
gagtttcaattgagatgatattgcttagcgatgttgcggaattgatgggattgtgattctccatgaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacaaaaaaaaaaaa

SEQ ID NO: 40686 - DNA, 2171 bp, Homo sapiens
acttttgaagagtgtcattcattttatagatggtaccttctatttgtatattcttggttccagtttacttcctagaaagcttcaagagtgtcccgctcacccacccacacaccaccttgttctgttgagtttagatttttgtcaaggttacattttgagacccgtttgaagtagctgagcttgaagttgaaaagtagctacatgtggtaaaaactgtaggtgatttaagttacttaagcctcgttgcctatagtttaattttgatactccatggaaatagtgaactcagaaaataccacttgttgactattttctctcttttttttatatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacaaaaaaaaaaaa

SEQ ID NO: 40687 - DNA, 2540 bp, Homo sapiens
agcggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggaataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaaatacactagaaagcattttagtaagaaatgctggccctttcttaaaacatttctcttgcatataccaggatgggagtaaaagatgccttaatatttagtttttgtattgttggagacattgattttaataaaatcctatttatctgctgttgtgtgcttttagttgttggataactgaggtctcctaaatggttcaacataaaaccacatttcaagtcttgtttctttttggagtgtcttttcaagtattcaaatgtatttctcaacctgagcatctttttaatcatatacatgggagtcttttaaatgctgaactgttacacatgcttgatttaaaaataataataatagaggaaactattggtctagttgtgccaagaaaagtttctgatgtttatgtgtgatgtacagtgattttgtatatgcgcccagctttaagaacacataaaactattacgtctggtaggaagattgttagtgcctcaagttacacctgtgcagcttgggtctgagttttgatagaacagtaaacatttaaagaagttaagagcagtttgagctgtatccgcggtttttactcgttaactgacttcagctaaatagtttgaattatagagtaagtataattacagcaaaggagttaatctcattttcaaagctgtttctcattttatttcttgaattaatgtagagcaaaacatgttaaaattcaggaccactggaatatggcaacttatgtttcagggttgtgtgtgggtagtatttgtggttgtattggtttgttttttgtttttggagaaacatctgctagtggaataaaatactttgttttgctctgaagagactgaaattgttcaggcttattatggctcatagattacagagaatgatgctagttacatgccaatgaactatttttactctttttatatgaaatgtaaaaatttgtaggggttctggtgatggtggtacctcttattaccttatgtaaaacacttgaacagcctcatcaatattgccgtcatctgtttaacactcccagtatattttctcaatgtctgtttacttaaaattttgtggagtgacataattaataagcaataaagtctgaattatacacaaaaaaaaaaaa

SEQ ID NO: 40688 - DNA, 913 bp, Homo sapiens
agcggagacgctgcacttcccaggccccaccagccgcggctccggctcgtagcccacagcccactgccggcggctgggcgctgccgaggctcggggcgcgcgcagttggcgtctgccagtgccaagactgtgccgcccccacagccgaggcgcgaaagggggacgcccggcctctgggccgctgccttcgctttctcttcgttgttgcgaacgccgtccgctcaggaggcgccccgcgaccggcgcgatgagtgccaacgaggaccaggagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttaacaacaccatatcatcagctgtaaagcagagtatattagccaagctacaggaagcagtagaagctaatcttggaaccgctatgacctatacattgtttgaatatgccaaagacaataaagagcagttcatggagaatcacaatcccatcaattccgcaacatcgataagcaatatcatctcaattgaaactcctaatacagccccatcaagtaagaaaaaagacaaaaaagaacaactttcaaaagcccagaagcgtaagctggcagacaaaacagatcacaaaggagaactacatattcaaagaacatagtgaggtataaaaaagtattctttcttttaaatgtgtatataatatgtttgtatagttagtattacctcttcatcttgctatagagttcctctactagtaaatatagcaataagccaggcctcatgaactgcttgggctgtttggggatcc

SEQ ID NO: 40689 - DNA, 870 bp, Homo sapiens
gtggatttactaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagacagttttttcttggtcaaataaaaatttaattaaaactttaaaaatgttgagtttttaatccatttatccgtgttcatactaacgtgtagtattccataaagcctattagaaccctgaattcaaacttgccttctctgtgatatcctgtttcttacttggtagtttc

SEQ ID NO: 40690 - DNA, 800 bp, Homo sapiens
gtggatttactaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagaggtggggaggccacagcttatgtgaatgactttctcaggagttataaagtgatacagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagacagttttttcttggtcaaataaaaatttaattaaaacttta

SEQ ID NO: 40691 - DNA, 1242 bp, Homo sapiens
gtccttgaaatcaagctgactctgcttttagcctcctaaatgaaaaggtagatagaacaggtcttgtttgcaaaataaattcaagacctacttatctaccaacagcaattacacgctttccattgtcttcctatagaaaataggagtagtacacttatagatgagaaaactggagaaagacatagtgaacatgtgagaatcttgctctactaattgataggaaggtgactagaaattggcgaagttttcttggtaagttgaggagaggacttttcttatagtgcagtctggtagctgaaccgccttgcatcaagaccaatgtagtcttatttacagaatgccacatcacagtgaattgtgctgtggacagcttccagtgtgtgagttgtggaagatgatgattttaacagattttggaggatgagaagtattaagaagaaggccccactgtccatgcatttgctctgctttttacttttgaccaagtatacacttcagaaatatcttattggatgtatacaaagtgattgtgtgtcatttgaaccagcaggaagtaatttattaaacacacttttctaaataaaagtcatttaattttatcagaaatcagtgtcattttagattgcaagtctcaaaccaactttccaattctgacttgtaagggtgccttaaatcctgaatactgtactctgtattactaaacccatgttagtttacgccaagattctgtggtggttttacatattctttttcccctttgttaaggtggggaggccacagcttatgtgaatgactttctcaggagttataaagtgatacaggtaaagctaagaaaagaacagattttgataacttttgttttaactgtccagtgttagggattgtggctacagtggtctaatttttaaaaactcttttttttgctttgttttttaacagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagacagttttttcttggtcaaataaaaatttaattaaaacttta

SEQ ID NO: 40692 - DNA, 881 bp, Homo sapiens
gtggatttactaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagaggtgagtgtggcacttaacctctcctgggagggggaggaataaggcagtgtttccaagaggtgattttggagctatacaggcattaggtagacaaggaaggggaggtccattctgggtgcctaggactctgtggctgatttataaatcgtaaatggtacaaaaaacagtgttgagtatcttttacctttctccagagtactgttcttacttttggatagtgcttcttgttttttccttccctctccctgtccctgtcacctttaaattaaatgaatgtttggaaggaagtaggagggtaagaatctttctgggtggcagaataatagatgggtctaccaagagcgatgtatatacccagtaaagccatctctaaaactgtgtttctgcattgttacagtgcatagttgggaaatctcagttttgttggctgtgtactttcc

SEQ ID NO: 40693 - DNA, 928 bp, Homo sapiens
gtggatttactaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggttagtataaatgtggaagggagaagtatgcactcaccagactaaagtttacagttttcacataggttgtgctgttctgtgtcccataagggcctgcgagaacccagacattctgaatcggtgacgcctgctggaggcagcaacacctgttgcattaattttagaacacacacacacggagttggtaattcttaagcttcctgaatctgctggcggtcatttggtgtcagaagcagagcaaagccatcttggtcatctccctccttttagcttaaaccgaagcatgatgggggagataggccgaaagttatacagcttgttaataacagagccgagagtgaaagcgcgatttcttcatttttagcccggaattatttgttgtacaccatactgtttctttgcattgctagacaattcgtctttttttacgaggttgacggggagttgcaaggaggagtgaaaagggtggtaatgtacatctacatacagtataaatccatgaaaggcaaaatccgtgtgtgttaggagttagaactgtgtcagtcatctacatcttccatagtttgtagatggagatgagtctgtcacgtcgctctgtcatttcccttttagcaacagatgtgtagtaacaatatgtgaagaa

SEQ ID NO: 40694 - DNA, 910 bp, Homo sapiens
caagccgaagccccagcaatagcgtcccaggtcttacacgatctgtaccgatcccagcccagcaaggctccctggcctcctcgctgacttcgctcgcctctatctctttgccccactgtccatgcatttgctctgctttttacttttgaccaagtatacacttcagaaatatcttattggatgtatacaaagtgattgtgtgtcatttgaaccagcaggaagtaatttattaaacacacttttctaaataaaagtcatttaattttatcagaaatcagtgtcattttagattgcaagtctcaaaccaactttccaattctgacttgtaagggtgccttaaatcctgaatactgtactctgtattactaaacccatgttagtttacgccaagattctgtggtggttttacatattctttttcccctttgttaaggtggggaggccacagcttatgtgaatgactttctcaggagttataaagtgatacaggtaaagctaagaaaagaacagattttgataacttttgttttaactgtccagtgttagggattgtggctacagtggtctaatttttaaaaactcttttttttgctttgttttttaacagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagacagttttttcttggtcaaataaaaatttaattaaaacttta

SEQ ID NO: 40695 - DNA, 918 bp, Homo sapiens
gtggatttactaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagaggtggggaggccacagcttatgtgaatgactttctcaggagttataaagtgatacaggtaaagctaagaaaagaacagattttgataacttttgttttaactgtccagtgttagggattgtggctacagtggtctaatttttaaaaactcttttttttgctttgttttttaacagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagacagttttttcttggtcaaataaaaatttaattaaaacttta

SEQ ID NO: 40696 - DNA, 926 bp, Homo sapiens
gtggatttactaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagaggtggggaggccacagcttatgtgaatgactttctcaggagttataaagtgatacagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagacagttttttcttggtcaaataaaaatttaattaaaactttaaaaatgttgagtttttaatccatttatccgtgttcatactaacgtgtagtattccataaagcctattagaaccctgaattcaaacttgccttctctgtgatatcctgtttcttacttggtagtttc

SEQ ID NO: 40697 - DNA, 744 bp, Homo sapiens
gtggatttactaggaaggtgggacgttggaggggtggccgcatggagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacacaagtcaatgattgcagtatagccactgaagtaatctaaaagagacttatcagcaggttgcaggtgaacatggccttgaggtaaatctgtcccttgctgaatacagtttcagtagattgtttatagtagtttcaggaattgagattttttacaaaaatacaaaagttttgcttggttctgttctagatgttttcttctaaataaatgagaaagatgtttcaacaaaggctctttatgctgaataattgtgatgcttgaagttgctaatctgctttaagtggattttaaatgtcaggcaattctagacagttttttcttggtcaaataaaaatttaattaaaacttta

SEQ ID NO: 40698 - DNA, 1216 bp, Homo sapiens
tatttttagtagagacagggtttcaccatattggtcagactggtcttgaactcctgacctctggtgatccactcgcctcggcctcccaaagtgctgggattacaggcgtcagctaccgtgtccagccgaaacatgaagtttcaaaatgccaagatgtatcacagaagacactcagcagtcagccacatttatcttggagaagagttccaggacttaaatgtttgaatagtataaactagttttttaaaaagtctgcctgaagccgaagattaaatactttaaaaagttcactgggtgatcttggcatgttgacattatcttaacagtctaagcttgttaccttacaccaacctgacaggttcattagaagcacatgaatacatataaaaggcataaaagactgggtcaatgaatatgagctctgaattctaaaattcctttgcatttctaggcagtacttaccatagtatgtttacgtacctggtgagtgacaatgctcaaaaatttctgaagtattcatccacattatgctagcgaaatgtcaacattgtcctttaatattcaaatgcatgaaccatcactccttggcctttgggccaagatcaagtgtagtatccaaatgcatgaaccatgaaagctatcttaaaaggaaagttacatttaaaggaattgaatataaaccttcggttaatcttgctagcacgtagtcaatacatcagtatttttctgccccttttatagtcttactggaaatgactgtaaaacagaaacaaagctaagccatggtaaatagaacattaaatgcccaacctaatttattttgctaagagaaactgatgaactaaaagagaaacaactattgtctacattttagatatgggggaaaaaaccctgagattactaattatgtatcaccatcctcttaatgtagatcctgaaaatgatggtatcaatataatacatacagtggattcaccttttaaactggatctattacctttgatatttgtcttacactgaaaaattctgacatcttcaggaaaccaatatgatggataagctaaatgttgacttaaaatagttaaaccccttaataacatcctttagtttctattatttcactgcttaagttcagcatctgaataacaaaggtaacataagtagtacttaagatcccaaaggcccattacattctatcaataaagacaaaacaaaa

SEQ ID NO: 40699 - DNA, 375 bp, Homo sapiens
tttattttttaagctttattgaagtataattgatacaccataaattcatccattataggtgaacaattccacgactgttagtataacagaattgtacaatcatccccactatctaattttggaacattttttgttacccaaaaaagaaactttatgtctatttccagtcactccccattactattcccggccttaggccgcaactaatctatggtttgtctctatagatttgtgttttctggacacttcatataagagaactcatatggccaggcacagtggctcgcgcctgtaatcccagcactttgggaggccaaggcaggtggatcatgaggtcagagagatcgagaccatcctggctaacacggtgaaacc

SEQ ID NO: 40700 - DNA, 1499 bp, Homo sapiens
tatttttagtagagacagggtttcaccatattggtcagactggtcttgaactcctgacctctggtgatccactcgcctcggcctcccaaagtgctgggattacaggcgtcagctaccgtgtccagccgaaacatgaagtttcaaaatgccaagatgtatcacagaagacactcagcagtcagccacatttatcttggagaagagttccaggacttaaatgtttgaatagtataaactagttttttaaaaagtctgcctgaagccgaagattaaatactttaaaaagttcactgggtgatcttggcatgttgacattatcttaacagtctaagcttgttaccttacaccaacctgacaggttcattagaagcacatgaatacatataaaaggcataaaagactgggtcaatgaatatgagctctgaattctaaaattcctttgcatttctaggcagtacttaccatagtatgtttacgtacctggtgagtgacaatgctcaaaaatttctgaagtattcatccacattatgctagcgaaatgtcaacattgtcctttaatattcaaatgcatgaaccatcactccttggcctttgggccaagatcaagtgtagtatccaaatgcatgaaccatgaaagctatcttaaaaggaaagttacatttaaaggaattgaatataaaccttcggttaatcttgctagcacgtagtcaatacatcagtatttttctgccccttttatagtcttactggaaatgactgtaaaacagaaacaaagctaagccatggtaaatagaacattaaatgcccaacctaatttattttgctaagagaaactgatgaactaaaagagaaacaactattgtctacattttagatatgggggaaaaaaccctgagattactaattatgtatcaccatcctcttaatgtagatcctgaaaatgatggtatcaatataatacatacagtggattcaccttttaaactggatctattacctttgatatttgtcttacactgaaaaattctgacatcttcaggaaaccaatatgatggataagctaaatgttgacttaaaatagttaaaccccttaataacatcctttagtttctattatttcactgcttaagttcagcatctgaataacaaaggtaacataagtagtacttaagatcccaaaggcccattacattctatcaataaagacaaaacaaaactacatgtttactgaaaatagtctttttttctttgctttccagttttacacttttgttgaacacaaaaaagtggacaagatcaaataactagatggtaaaacactgattttttaaaaatcacatctttaaacccgtgagaatcacaattcaaagtatggccactgggggcaacctgtaaacctacaaccttttcttaacactgacactatgtgactgatttttcttaaaacacaaatgccattaagaaagtattttttgttgacacattctgcaaaaaaaaaa

SEQ ID NO: 40701 - DNA, 1391 bp, Homo sapiens
tttattttttaagctttattgaagtataattgatacaccataaattcatccattataggtgaacaattccacgactgttagtataacagaattgtacaatcatccccactatctaattttggaacattttttgttacccaaaaaagaaactttatgtctatttccagtcactccccattactattcccggccttaggccgcaactaatctatggtttgtctctatagatttgtgttttctggacacttcatataagagaactcatatggccaggcacagtggctcgcgcctgtaatcccaccgaaacatgaagtttcaaaatgccaagatgtatcacagaagacactcagcagtcagccacatttatcttggagaagagttccaggacttaaatgtttgaatagtataaactagttttttaaaaagtctgcctgaagccgaagattaaatactttaaaaagttcactgggtgatcttggcatgttgacattatcttaacagtctaagcttgttaccttacaccaacctgacaggttcattagaagcacatgaatacatataaaaggcataaaagactgggtcaatgaatatgagctctgaattctaaaattcctttgcatttctaggcagtacttaccatagtatgtttacgtacctggtgagtgacaatgctcaaaaatttctgaagtattcatccacattatgctagcgaaatgtcaacattgtcctttaatattcaaatgcatgaaccatcactccttggcctttgggccaagatcaagtgtagtatccaaatgcatgaaccatgaaagctatcttaaaaggaaagttacatttaaaggaattgaatataaaccttcggttaatcttgctagcacgtagtcaatacatcagtatttttctgccccttttatagtcttactggaaatgactgtaaaacagaaacaaagctaagccatggtaaatagaacattaaatgcccaacctaatttattttgctaagagaaactgatgaactaaaagagaaacaactattgtctacattttagatatgggggaaaaaaccctgagattactaattatgtatcaccatcctcttaatgtagatcctgaaaatgatggtatcaatataatacatacagtggattcaccttttaaactggatctattacctttgatatttgtcttacactgaaaaattctgacatcttcaggaaaccaatatgatggataagctaaatgttgacttaaaatagttaaaccccttaataacatcctttagtttctattatttcactgcttaagttcagcatctgaataacaaaggtaacataagtagtacttaagatcccaaaggcccattacattctatcaataaagacaaaacaaaa

SEQ ID NO: 40702 - DNA, 408 bp, Homo sapiens
atactttccctgtgacatttttaaacttcttccctatattacagtcatccttgtacatgactaatattccacaatggatcataaattgagggtaaagcctgtgtataatttgtatgttaattttccaatgtacctaccatagtgccttacacagagcagatatccagtaggtcttggaatacatatatgaaacatataaaatgcatctgtggaaagacaaataagaaacaaaactcatacttttcagaacttactatcccaggaaattcacttttttcaagaagttttcagcagtatttcttgccctttggcttgttttcctgtgcagagatttgggacctctatcttttcctactaacttaccctacctccccatgataggccattaaattatagttgcactttctc

SEQ ID NO: 40703 - DNA, 415 bp, Homo sapiens
agtagccacacactggagctgtttcagcccctatttggtaacaacagtagagatcacttttttagcttaacgagggtcatctttctcaataatgtgtaaatagtcctaagggtgattatgtaataaatatatacccttcacatgttagtacataaaaacccattatatctttcctgagagaggatttaaataggcaggagagaattaatagtcatacttacccgggtagagtttttgacaatggcaatgtaagaaatgcacagtgttgaagattagacaatgaactctagaacattttgtctacgcctcccccatacttcccatatctaaaatttgtggaaaaggttaaaatactattacattttatttaaataattttaaaaagtattattttagtacgattgagtgtcttctc

SEQ ID NO: 40704 - DNA, 408 bp, Homo sapiens
ctcagatagcctcctctcctatcctcagactccacagccatgccccttggcctctccctaccccagcagggaggtgtctttagtcccgggcagccagatgctccaaggcagggcctccgaccccacaaagggtgagaggattcacctggagctgggctggaagatgcaggaaaagcccctgcccccggggcctactcaacccagcccatgctcatgcatgccaggtcactgcagcagatcccatgaaaaaccaagacggccatgtcaccagcccgtcctctcctgaacacccagctcactctcgccttcttcctctggagagaggaccagaggccagagtcagctctggggtatagagattccctgctctgtcctgggaggcaggaccaggactagggtgagcaagtg

SEQ ID NO: 40705 - DNA, 601 bp, Homo sapiens
tgaccttctgggctcaagcaatcctctcagcctcccaagtagccgggaccacaggcacatgccaccacacccagctaatttttggtagaggcagagtctcaccttattgttcaggctggtctcaaattcctgggttcaagtgatccttccacctcagtactgggattacaatgattctgtttttaaatgattattttggcgtttgtgtggagaagctattgaagggggcaattctagggaggtgatgatgcagctgtaactagagtgatggtaatagattgcaaaggggattattaaaggtttatttggagggagaaagaaagtctaagaattattgatgttaggagtaaaggagtgtgagggaaactagggtaattgtttgatcaatggaaccatgcccaatgatatgaaatatcaagagagaaaccagtttggaatggataaatctgaaattttgttttacaaatggtaaacttggcatggctgttaaatcccaaatgttggcatcattggaacatggggacgagtgacggcaggaggaccacgaggaaatacccatcaaaactaacttgtttacaacaaaataaagtattcactacca

SEQ ID NO: 40706 - DNA, 911 bp, Homo sapiens
ccacagaaagtaaagcaaatccaggcttagaattagacctgtttgtggggagcagaaaggattgggatggggaggcatagtggagcaacacatctgagacaggaagtacggcccctgttctgttggcagtggacctcttcagtcagtagccaaggtcacagccctgagccgatgatgctccatgctgctgcctggatggaaagcattcgaggggaccttttggccaccagcattatgctgacagtcccagctcagacagaaggccttcttgtggcctcttttctgaggtaggaaggaaggttccgggtcaggaagtacatggtttgttgtaggtctgatgtgaacagtttgttgtcactaaccagccctggctagcaagaattccagaagagggatttggcagggacccatgtggtattgcaacctgtcaatacatcttgacaagtttgtaaatcagtcttcctggcagccagcttcacatagtatctaacacagacaggatttgctcaccaaaaacagagatgagtttgtttttggaggcctctgctgttacttctggccatttacctcttgcataatgtaaggtagccttttctcatctttgccctccaatgcccatctggttctcagacaatccccaaaccccacaaaaatggctgtttagaagaggaaggataaacagttggcccttggtatctgcaggttccacattcatggagtcaacaaaccataaatcaaaaacattttggggaaaaaaaaacagtgaaaattaacaatacaattagtctgggaacggtggttcacacctataatcccagtactttgggaggctgaggtaggcagattttttagcccagaaatttgagaccagcttaggcaacatggtgaaaccctgtctctacaaaacaaaa

SEQ ID NO: 40707 - DNA, 2540 bp, Homo sapiens
tcccattttggatgtttcatataaatggaattatacactatgtgttctgtgactgacttctttcctgtaacacagtttttccaaggtttcaccatggggtgggcagggtgtggtggctcacatgtatactaatcccagcgtgttggttgggaggccaaggtggaaggatcgcttgaggccaggagttcaagaccagcttgacaacatagcaaaaccccatctctgtaaaaaaaaataaaaataaaccaggcatgggtgtgtgcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggttgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccatgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaaaaaaaaaaaaaaaaaaaaaaaaaaaaaaaaaaaaaaaaaaaaaaaaaaaaaaaaaagagaggccaacaaaaaaaaaaactcaccaccaaagagaagagaccccaaaaaaacaacacccacaattaccaaacaaaaagaggaccccgaggaccccttttttaacccccggccaggccccttcaaaccacacccgcccactgtggcgaacaacgggccgcccagcagagcaaccttccgggcgaaaaagacaccctccacagtcgggggggcggacacacaaaaggggaccaacgtacactcaaagaaaatattacacgccacatcgagggaagaacacacacccacagccgggtgacgggacgtcaaccagccgcaccatcaactgaccagcttcgacgcgcggacacagaatcatctgagcaacttttcacacacggaagaaaa

SEQ ID NO: 40708 - DNA, 1999 bp, Homo sapiens
tcccattttggatgtttcatataaatggaattatacactatgtgttctgtgactgacttctttcctgtaacacagtttttccaaggtttcaccatggggtgggcagggtgtggtggctcacatgtatactaatcccagcgtgttggttgggaggccaaggtggaaggatcgcttgaggccaggagttcaagaccagcttgacaacatagcaaaaccccatctctgtaaaaaaaaataaaaataaaccaggcatgggtgtgtgcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggttgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccatgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtaattagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagaga

SEQ ID NO: 40709 - DNA, 1692 bp, Homo sapiens
tcccattttggatgtttcatataaatggaattatacactatgtgttctgtgactgacttctttcctgtaacacagtttttccaaggtttcaccatggggtgggcagggtgtggtggctcacatgtatactaatcccagcgtgttggttgggaggccaaggtggaaggatcgcttgaggccaggagttcaagaccagcttgacaacatagcaaaaccccatctctgtaaaaaaaaataaaaataaaccaggcatgggtgtgtgcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggttgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcactggatgagggcatgccactggatgagggcatggcgttggattgttcacccactggatgagggcatgccactggactgagggcatggggtaccgag

SEQ ID NO: 40710 - DNA, 710 bp, Homo sapiens
  misc_feature (83)..(83): n is a, c, g, or t
aagtcaggcagagaggtttttgacttggctaggcactgtggctcacgcccataatctcagtgttttggtaggctggggtgggnaggatcacttgaggccaggagtatgagaccagatcccgtctctacaaaaagtaaaaaataaattagttgggcgcgatggcacacacctgtagtctcaactactcagaaggctgaggcaggaggattgcctgagcccagcagttcaaggctgcagtgagctatgatcacatgccactgcattccagcctgggtgacagagcaagtcaaaaaagtggggtgggtgtgcaagtggggttgttagactagaaacctaaaacacaaatctaacaaagaaacaaatcagtaaatgagacttcctcaaaattaaacattttgttctatgtaaaaagatcctattaagaagacaagccaggcgcagtggcatgcatctgtagtcccagctactcaggaggctgaggcaggagggctgctcgagcccaggaatttgagattaaggtaaactataatcactcttgtgaacagccactgcactgcagcctgagcaacacagtgagatcccatgtcaaaaacaaacaaggaaacaaacaaaaaaaaagacaagttacaccacaggagaaaagatctgcaaaccacaaacccaacgaaggactagaatctagaatctagaaagaactctgaaaactcata

SEQ ID NO: 40711 - DNA, 983 bp, Homo sapiens
cattgtctttaggacaatatccttccaatcttagctgatcaagtactctgtgttttcctatccggttttactacccatgacttcttggcggtaattcctatctaccttcctaatcatttctcttcattcacttaatacttcaactactgactcactgccttcctgtacatcttcattcctgtcattgttcttagtgattccaagaaccatgtagaagaaacactctgaactttagcttctctattccttgacctctcctctttcaatgttttcctctatcccacctttgccacctatcacaagaccactggaacttatcaccactaatgaaaccacctggtaattctttatttgaagcatcctactttatgaccatcacctcctgttcttctaattcatttacctgagtcttccattgctgcagttctttagccctattgtaatctgcaaactactgttttccttgtttgaacttcagtagcttaacattggtagaaaatactagggtgactgataacacttgaaattcatcacaaaaacttcaactagccattcaatactgcctaccattcttgtatgtttttctagcagatttgcttttgactttctcagatgacagttgaaaacctgcacttcacccttcacacaccttccctgcttaactgagaaaacagaaggtatccgctgggcacagtgactcaagcctgtgatcccagcattttgggaggctaaagtgggaagattgcttgagcctaggagttccagacctgcctggtcaacatagcatgatcatgtccctatttaaaaaaaaaaaaattagccaggcatggtgaagcatgcctatagtcccagctactctggaggctgaggcaggaggattgcctgaacctaggagtccaaatgactgggtttgtgaaggctacagtgagccatgactgtaccactgtacttcaacctgtgcagcaaagtgataccttgtctca

SEQ ID NO: 40712 - DNA, 689 bp, Homo sapiens
gatgcacccatcttccgggccctccacatgcaggtcccaatctaccaattgcctttttaaagaaactatgacgtacagttccctgttgtaaccacgggcaggtatttgctgacttgcctacaacctggagggttatgagctggcgtcgccccatttcacagagggagagccgaggtgcagagagacgaagctgctgactggaggagacatagacccaagcagcgagcccgcgcggcaatttagggaaccaactgtgtgtgctgcgggggtcccttgccacccaaactgggatataggctgctgttcgtacacttgcagaagtttctccctgcagctaccgccaccaataatattcacacagccttcccacatgctatgtaaagactccaaccttccccacctcccaagatgcatcctgttactatagccattttacagatgaggaaaccgaggttccaagaggggcagtctctgctctctaaacttcaccttccaaaggattctaagctgctgaatgaaggctgcaggcagggtggtctgtacaggggagggagggtggaaggcacggggtctggaagtctaggaggagtgtctgaagtcaactgcaacttttaaatatctgtgaattttagatttcaccctgtatgtgtccctagcgtgttttaataaaataaattgcttcacgttaa

SEQ ID NO: 40713 - DNA, 441 bp, Homo sapiens
ggcaaaaaaataaatattcttttgaaaacagataatatttatgagaacctattgctatgtgccatccatgtgtcttgctatcttccaattctgcctatgaaatgctccattgaaaggtgacccaaaagtgttacatgtgtaaacagactatcagaaaatgatagagacagagagggagagagatatgaactcgtattgctaactattgctaaattattgccaactattgctaaattatttggaaattcttcatataagattacttatcatccacctaacttaaaaagcattttcccagttattataaagttcaaattaatttgatttgttcctaaaaaaatgtcagtttgcttacaatttaaacttttatttaaggtagaaagtttcccttctgagcaacaagttacgggctggaagtggtaaaaaaaatctctaggagag

SEQ ID NO: 40714 - DNA, 821 bp, Homo sapiens
acggggtttcaccatgttagccaggatggtctcgatctcctgacctcgtgatctgccagcctcggcctcccaaagttctgggattacaggcatgagccacagcgcccggccaaaatccgcacatcttaaaggacaagaagaggtatttacgcctcctggagattcacaaaataatgcggacgctaccgactgccagatctttacactcacccctccacctgccccgaggagtccggtcacaagggcccagcccatcacaaagacacccaggtgtcccttccatttttttccacgaaggcccagaatccattttaggtttccaaacagacctttcgtcccttcaaggtgtaaccaccgttttccattccagccattttattggccacaccgttaccttacttataggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggatttgaagattaagtatcctaaacatcactgactagaaactgttctctttgtcagcagtgaagatattggatcataggttattgatggttgcaaaattggacaataaccacgttatttttatcctcaacctcttatggtcacaggatatttatgcaaataaaatctttaaatgggtggatctagtaattcctatccatactaagatgctgagagaatccatctcctcctctaaattaaacaggatttaaataaattgagat

SEQ ID NO: 40715 - DNA, 777 bp, Homo sapiens
gtgactgctcagtagaagccatggctcgcagacactgcttctcctactggttactggtatgctggttggtggtaactgtggcagaaggacaagaagaggtatttacgcctcctggagattcacaaaataatgcggacgctaccgactgccagatctttacactcacccctccacctgccccgaggagtccggtcacaagggcccagcccatcacaaagacacccaggtgtcccttccatttttttccacgaaggcccagaatccattttaggtttccaaacagacctttcgtcccttcaaggtgtaaccaccgttttccattccagccattttattggccacaccgttaccttacttataggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggatttgaagattaagtatcctaaacatcactgactagaaactgttctctttgtcagcagtgaagatattggatcataggttattgatggttgcaaaattggacaataaccacgttatttttatcctcaacctcttatggtcacaggatatttatgcaaataaaatctttaaatgggtggatctagtaattcctatccatactaagatgctgagagaatccatctcctcctctaaattaaacaggatttaaataaattgagat

SEQ ID NO: 40716 - DNA, 642 bp, Homo sapiens
gtgactgctcagtagaagccatggctcgcagacactgcttctcctactggttactggtatgctggttggtggtaactgtggcagaaggacaagaagaggtatttacgcctcctggagattcacaaaataatgcggacgctaccgactgccagatctttacactcacccctccacctgccccgaggagtccggtcacaagggcccagcccatcacaaagacacccaggtatttccccagaagaagactccagagaggaagctcatctgaggaaagctgagagggaagagaaacccaaacatactgaagcaaaaaaaagcctatccttcagaaaaaagcaacaaaaagatttctgttttatctttcgaaactaaaactattggatttgaagattaagtatcctaaacatcactgactagaaactgttctctttgtcagcagtgaagatattggatcataggttattgatggttgcaaaattggacaataaccacgttatttttatcctcaacctcttatggtcacaggatatttatgcaaataaaatctttaaatgggtggatctagtaattcctatccatactaagatgctgagagaatccatctcctcctctaaattaaacaggatttaaataaattgagat

SEQ ID NO: 40717 - DNA, 545 bp, Homo sapiens
  misc_feature (533)..(533): n is a, c, g, or t
ctactactactaaattcgcggccgcgtcgacgatggattgcttaatagataatgttaggagaattgactaattaaaatggagaaacattaactggatctgcacagactatcatacacaatggtagactctagaagggctaaagacctaaatgagaatggtaacaccacaaaattaatacgtctcttatctacaaatctgaaatccagaacactctgaaaattaaatgctttttcttaacccacatggcagcaaaacttgagctgaggtgaagctatttataatcatgtatttatcctgcttaatgtgaatatcctataattcactgcagttttaaaaaactattattataaaaactttcaaacattcagaaaaatttaaaaatagtattagagggccgggcgtggtggctcatgcctgtggtccaggcatttggggaggcttgggtgggagtatcacttggggccgggagttcgggaccagcctggtgaaaaagagcgagaccttgtcttaaaagtcgacgcggccgcgaatntagtagtagtag

SEQ ID NO: 40718 - DNA, 460 bp, Homo sapiens
gctaagtgatttctataatttgcagatttggtctcagctaagagctaaaactgttcatagcagcactaaggaggcctatacccctacagggaaattataaaattttatatattttaactctttcactactgccaacattcagcacatagtgttttcttccaatcttaatggtttatttcatttcattgtgtttgttgtggggattattaaagcagtcacaacagagcctagcacatagtatatgcttttgcaacttttttttgagggggagtctccctctgtcacccaggctggagtacaatagggcaatctcagctcactgcaaactccgcttcccagattcaagtgattctcgtacctcagcctcctgaatagctgggattacagcatctgccagcacgcctggctaatttttgtatgtttagtagagatgaggtttcaccatgttggccaggctggt

SEQ ID NO: 40719 - DNA, 321 bp, Homo sapiens
aactcttcagacagtacctggcacagagggactgctcagtctgagctagcaattatgatgctcaaaatcctgcagacactgcccatagcctctggcattaaactcaagcctccttgacaaggctcagtgcactggacttcccctggttcagagacactggcctgtgtgtgggttctccctcctccaccagtgtttcatgcttccatgcctttgcccaacttaacttcccttgtgatatccttttcccaacctgaatgcccctcccttcctcatgtctctggcatttctaaccatctttctttttttttgagatggagtctc

SEQ ID NO: 40720 - DNA, 275 bp, Homo sapiens
atgtaaaacaaccagaattttcacacattgttagtagaatatactcctatcctatcacccaacagttttactcctaggtatttacctaagagaactgaaaatacatatccacacacaaaaatacagcttgtataaaaaagttcttggcagctttattccaaatagccaaaaactggaaaaagtgttaaatgtccatccacagaagcatggataaacaaattaccatatatctgacaaaatggaatactactcagcaaaaaacaacaacaaaacag

SEQ ID NO: 40721 - DNA, 488 bp, Homo sapiens
ctggaagggccctgggaattcagccagcccaaccccttggtgcacagacaggagacgggcccatgagggtgttggtctcttccaggcctaggagcacctggggcagacccaggctcagaactcagcgcacctgaggcccatggagctccacccagcttccatctcagacagtcataggctaggcctggaagagctaaagaaacctcttggcatagaacccctgtcctactttacagagaggcaattgaggtctgcagcagcaactccgtttacttagtgagaggaaaatgcttctaagaggcctggcctcccagaacaaacccagcaacctggttggtgtccatccctatgccaagggccatgacagccatccacacaagagaggatgggcgccgctcgcctcaccagaaggtctaggcacttctttttttgttttttatttttgtttttttttttctgggcaacaagagcaaaactcctccatctca

SEQ ID NO: 40722 - DNA, 1095 bp, Homo sapiens
gaggcggaggttgcagtgagccgagatcgcgccactgcactccagcctggaagacagagtgagactccttctcaaaaaaaaaaaaccttaaaattgatttgaagttgattatctttcataatcttctaattctcctttagaatgatccagtccattaaacactttgcagatgccagacctatgctctataaatccataaattaattcaatttattgaaagaagtagatatctataaaccccacactgaactggttaagcttaattgcaatcctagtccatcctagagagaaatcaaaataattgagaggttagggcattgtcgctgtgagaaagcttagaggtaacacattatatgttatctggagagaagaatgttaaatggaaacaaagtttatgaagaatttcttcaagtacctgaaggactttctgggaaattacaagatagcattcttaggttccatatgtctagaagacttttcataactgtaagcaacttttgcaaatggtttgggaacataaaactcttccagcatagaagaaaatgggtactattaacattcagatggttatgggaccatcataacagtttgatgtgatatgcaaaatgctgcatccccaactatgaccctcagtatgacttttaagggaattataagctccaaatactttttggagtataaacagtacttgactttttcacacatttgctaatacccttctcataagttttatttctttctgatgtttcagctaacactgagttaacagaagctaaataataataaaatgaagaacagatagtaaatatattgaaattgtcattcctggccgggtgtggtggcttacgcctataatcccagcactttgggaggccaaggcaggcagatcacgaggtcaggagatcgaggccatcctggccaacatggtgaaaccctgtctccactaaaaatacaaaaattagctgggtatggtgacgcatgcctataatcccagctactcgggagactgaggcataagaatcacttgaacccaggaggtcgcgccgctgcactccagcccggtgacagagcaagactccgtctcaaaaaaaaaaa

SEQ ID NO: 40723 - DNA, 340 bp, Homo sapiens
gttgcagtgagccaagatcgcaccactgcactccagcccgggcgacagagcgaaactctgtcttggggaaaaaaaaaaaaaaggatgacattttaatatttcttatgcatttgtctcttccacaagtggaaagacaaagtatagaacaagacatccacacttttcaagaaaaatgggagagagcctatttttttttgtggaagtaaagaatgttcctacatgttgaatatgcaaagtctgtctgtgttgaaagagcataccctaagacactattatgaaacaaaccatagcaagaaccacgatggatatacagaaaagatgcgtgacaaaaaacttaaca

SEQ ID NO: 40724 - DNA, 465 bp, Homo sapiens
gagctatctccactgcccctgcctcttcagaacccgcatcgtggttttccggggtcactccagcagcttcccacaggtctcccggtgtctgcacttgctccctgcagtctgttgtaacacaaaggcagaaaaatcttattaaaagacaagccaagtcaagccatgtctctcctcttgtcacagaggagtgacaagccatgtcactcctctgctcaaaacccctcattcactccctgctcttctcagaataaaagcctacgtccttcaatggcagctaaggtcttccatgacctgctctcatttcctccttggtctcatttcctattactttcacctgtggactcatctctagctgcatttgtctcctttgtttcctcaaacacataggcatgtccccagcctcagtagcctctacctgcctggaatgttcttcctccaggtatctgaggcactgtctccttcacc

SEQ ID NO: 40725 - DNA, 496 bp, Homo sapiens
tgtttttaagctctgttttcaggtgcatatatatttataattgttatgtcttctaggtggattaagccttttgtcattctttgcctttatgtatgctgttctctttcccaggaatgtctggagtatctttttatttctaccctggaccctgctgatattttacccattctcccaacatacatcttaaatagtgtttattttgaggtagttctcagactttctggtagttgtgattactctcgctacagattttgtatagctctgttatgaaatttatgcttttgtctttctacccctaattaaagggattgtttcatctttgtacctcattccatgcctagtatggtaggcatttaataaatatttctaacatagaaaaagaattaggtttttttggatggtcctagacaattggtgtaggacaaagggtagaagttaataggaagcgtattttagttccattttttaaagaaaagaaaataacgttttaattact

SEQ ID NO: 40726 - DNA, 317 bp, Homo sapiens
aaaggtcctgtgttttctttttagtagtgtgtgtctgcagagacatcctaatgtagtctaggtgcaggagttgaaggcagcagtatggaaggaagtctttatctataaagatagttgtcagggtatcactactttgttaaatttttttatacttaggatgtgggctttatcctagcagggagagagactgggtcttatatctatacccagcattcattcagtaccccaacttttagtatactaatattacttgggatggatatatgagcccaaatgccaccttagtactttctactgagtgcaagtcatgcacacat

SEQ ID NO: 40727 - DNA, 406 bp, Homo sapiens
ggtcacatggaggttttctggtctagagcacaactgagctccccagaaacaacccagcatcaaatggctggcccatgtgacccagctggcatggacattcccagaccagtctgtccttctgtcaccttagctacagggaaggcccatgaccccagaagtgcccgtcattatgctgaattctctgcctcagtggcccaccgaggtgtgcaagcatgtctcacaagggtcagatggagttctggcctggattgatgtgtagatgctggagagagaagctgggtttcttttggctgggtgctctgctggtatgtggtgggccttgggtttccaggtggtcattttccttatttgcagaaggaatgaggcccatatagagaatagagcaaattaaagggagagaaagaga

SEQ ID NO: 40728 - DNA, 363 bp, Homo sapiens
agacacataccaaaagccaaacaggcctccccaaaacggaggactctgaccagcaggcccatatcccaggaggacctgaaggaccatctggaacagaagggtagagagtcacggtgaagccagagaagctctctccgtgggaatgggaacaaggtgggacttgtgccaggtggtggcatccccggttctatagaatgggcagcactgagatctgcctttttagtggcacagggtgattctggagcctccaagcctcccctgtgtgagcgggtgaggcagggagagcataccccaggcttcctacaggaaagggctgccctcccccgccggctctgacactatcatctactctcctcccagttc

SEQ ID NO: 40729 - DNA, 568 bp, Homo sapiens
ttccttccagttaatttgaccatgagaagaaaactgcgcaaacacaattgccttcagaggagatgtatgcctctccattcacgagtacccttcccctgagatgagatctggctctatcacccaggctaaagtgcagtggcatgatctaggctaactccctggctcaagcgatccttccacctcagcctcccaagtacctgggactacaggcactcacggccacacctgactaatttttgtatttttttgtagagatggagtatcgccatgttgcccagcttcctttgaggaatgaaaatcattgtttgctgtacatttgatcagaagaaaaaagaaaaactgaaattagtgaagtcagtgaagtcttcggtcccgtcctgaatcatttttaccctctgtttagggacaggtctagaacgagtgagcacaaaactgaagagtgtgccgaaaatctcagcaatcaagataacatttgaactccatttttgaaaaaaataaaaactaacacccacgaaaaatacatgatgaataaaacatcaaaattttagataaacacaggatatcagga

SEQ ID NO: 40730 - DNA, 390 bp, Homo sapiens
ttccttccagttaatttgaccatgagaagaaaactgcgcaaacacaattgccttcagaggagatgtatgcctctccattcacgagtacccttcccctgagcttcctttgaggaatgaaaatcattgtttgctgtacatttgatcagaagaaaaaagaaaaactgaaattagtgaagtcagtgaagtcttcggtcccgtcctgaatcatttttaccctctgtttagggacaggtctagaacgagtgagcacaaaactgaagagtgtgccgaaaatctcagcaatcaagataacatttgaactccatttttgaaaaaaataaaaactaacacccacgaaaaatacatgatgaataaaacatcaaaattttagataaacacaggatatcagga

SEQ ID NO: 40731 - DNA, 661 bp, Homo sapiens
gattactcaaaaaagaaactatcctgtctaaatttgaattgtgttgataactaggtgttccccagatgctaagatgttcttaatttgtatttattgaaggattgttagcttagtgccacaaaatttttcttactttatgttaattccagataagaaatttacaagtttatatcttttttttcttttttttaagatgagatctggctctatcacccaggctaaagtgcagtggcatgatctaggctaactccctggctcaagcgatccttccacctcagcctcccaagtacctgggactacaggcactcacggccacacctgactaatttttgtatttttttgtagagatggagtatcgccatgttgcccagcttcctttgaggaatgaaaatcattgtttgctgtacatttgatcagaagaaaaaagaaaaactgaaattagtgaagtcagtgaagtcttcggtcccgtcctgaatcatttttaccctctgtttagggacaggtctagaacgagtgagcacaaaactgaagagtgtgccgaaaatctcagcaatcaagataacatttgaactccatttttgaaaaaaataaaaactaacacccacgaaaaatacatgatgaataaaacatcaaaattttagataaacacaggatatcagga

SEQ ID NO: 40732 - DNA, 294 bp, Homo sapiens
ctctcttgaataagcaaagtgttaactctgagaatgaaggggcaaataaaaaaggacacttgtaagcagaccctccatttgggagaaccttaattacaggttgttagttgcagtggaaacccaggctgggtggccctccagctcattgtcttgccccttttctctctccctgggtgggtctcatgggtcagagatttggccccacccaacccagcagctatgggaagaaccaccttctctgtgaactcacactcattcagccgcttaaacaatgtgtcacccacccccaccctc

SEQ ID NO: 40733 - DNA, 395 bp, Homo sapiens
ctgtgggacagcatcattccaagtgctgggctagggatggaagcaagaggcaaagataaataactaagggtccctaccttcaagtgaatctctctcagtgtctctctctttcctcaaaacagctttgtttggtccccacaaaacacgagatgtcccctgatatggtgacatcatcagggcatcttcccttattagaaacattctggcctatttataccctcaaagtttttcaaactcactggcagttccactcctatatgcaagttttaaaaactggtacaccaatgggttaaaacaatgccactgatgaaacaaggaaatattcaaccgggctttgcaaattccaaacagttttctctgtatacaaataaacccggaagcatagattggaacaa

SEQ ID NO: 40734 - DNA, 369 bp, Homo sapiens
gtttaggaaaattcctacaaggaaaccctaacccaatatcaataactggaaagacagacaaaaaggactggggccgggtgcggtggctcatgatccacctgccttggccacccaaagttctgggattacaagtgtgagccaccacgcccgaccattgactaccaatttttaactgcacattttaaataaaataatatgccaacattgtaaatcaaatacccctccccttttgcttttgttatttctacttcttggttttgtttttgttgttgtttgcttttagtttctttcatggactaattttgtatagtttgtgtttttggtcatgagtaactactaaagtatttactgggatggtttggtgtcagc

SEQ ID NO: 40735 - DNA, 264 bp, Homo sapiens
tgtttaaactgtatatataaagtgtcttaaggtggagtgggtaattgattgactactggtataattttagagtcaccaaagagcacatcaaccttaatatactttcccacaaccccagtcacttccatattatgtgacctttattacaagaaaggaatactataggctaaaatttcttgtagatacatgcaaaaatgctcagcaaaatattaacaaatgaagccagcaacatacataaagaatgacaaaatggagtgtattcta

SEQ ID NO: 40736 - DNA, 449 bp, Homo sapiens
tcacaggaagaggcttggtggctacagaaagacagaaagatgcctgacctgcttccagctgcttcagcccccccactgtcccatctccagacacgtcaaactgcaactggatgacagacattaagctggaactttgcagaacaaattccatgaataataggacttggtccaggctcctaaccatctttcatccttgggtgtatccatcggcctaggaacacctaacaccacgtgatgtttaatcctacagcaaaccatcgacactttcagcttgaatgatcatgtatcacttagttttcaagtttaattcaagtgcatctacctcttctccactgttgacaccagaaaactcccttccatatgcccttgtggaactcactatacttcgttcaacaaacgttcagtgactacctgctatgtgtccagaataaattaagaatacagttaaa

SEQ ID NO: 40737 - DNA, 443 bp, Homo sapiens
catcttgaagcttttgggcttcaatgtaaacagttcagctaatctgggtctgccaagttatatcaaagcccaaagtagtccatgcagagagatcacaggaagaggcttggtggctacagaaagacagaaagatgcctgacctgcttccagctgcttcagcccccccactgtcccatctccagacacgtcaaactgcaactggatgacagacattaagctggaactttgcaggcaagccctttcttagcctgacccatggagaatgtgagagatgataaaattattaggattgttttggagtaatttgttgtgtagcaagaggtaactggaatacacctatttccaggaatttggcaatttctcctccctttaggtgcactgtttgatctgtgctaggcaatcctttccagttgtctcaggaacagacataactggctgcatct

SEQ ID NO: 40738 - DNA, 437 bp, Homo sapiens
tgcggtgggggtctccagggagacgtgcagcaggcccccttggagggtgacagcactatagttgagataagaaataatgcaattctccaggcagagctgcagtcttctagcccatataaatgattcctttagtgattttgccaaggattgtgttatgtgtgcttggggaaccaacatagcctgagaaaccgtcaatatttctggagaagggcaagtgtaatcagtcaagcattccagaaaaaatgtagtcaatgattttaacagcaagtggttttgactatgaaaagattcaactatgggatttttttgtttttttctttttccccaagaatcactctgagcaatttcttaaagaattaaaatgaaatgtttctcgggtaacaaatcacccagtcttacagcttggagctttatcactctccagctaatgggtctga

SEQ ID NO: 40739 - DNA, 327 bp, Homo sapiens
tgatgtgaggagctgcagactgcaggacaaagggttcagtaaagacttcattcaaaatttgtaacatggaaatcaaatgtgaacaacagaccccaaaaccatctgttcttgccagagccaagacggactccatggccagctgccagaattgtcctgggttgttctatacacactaggggagggagccacgtttccttctaacaaaaggccattatgcaaagggctgcctaatgaaatcgtccttttgatgtattctctttaactagagtaatgtaataaaatgataatgataatcttctggtttatgattattctgaattaacacca

SEQ ID NO: 40740 - DNA, 285 bp, Homo sapiens
ctgtgacacacacagatatatatatatgtgtgtgtatatatatatatacacacacacacaaacaaatgtacacacagtactactacatttattttagccatttcttcacttgtactgaggaagaacaatgtagtctctaggttcaagaacagaagcaaagcccctgtcagtctatggtcctcagattatccactggagtcagtaaactaattgctaattattactgagcccaaaactccaaaatgttgtcaaaaaataggcacataatatgtagacaataagtgg

SEQ ID NO: 40741 - DNA, 633 bp, Homo sapiens
ggaaattcttattttgatagcatttttataccccctatgcaaaactgaaaatgctagacaatgaaagaaatgtgtaaactgttgaatacaaggagccaggcattcataatagagccagctgatgctttgagagaagaaaaaacctcatgtctcctcttctcacctctccctcttttcttccaacattttattacgaaaatttttaaatatacagagaagttggtagaactgtacagggaacgccaatttgccctccacccagagtctgtaattactaacattttgccacatttcctttatcgcctctctgtacaatcatctgtccatctcagtttttatgtatttcagaataagttacagatgttagtacatttcaacaataggttacttttatttccactgttaattaggcttagtctgaagggtgtggaatattttcatttcctgaatggaataaaaggtgggagttaaaagcagatgggaacaagcagaatgatataatgtaattaaggcctggcttaaaaaaatatgtgtgcctgtgtatgcacacacacacattgtaaattttgtgtacatgcacataaaatatatatacacatgcgtgtgtgtggatatgtatgcatatctatatgt

SEQ ID NO: 40742 - DNA, 364 bp, Homo sapiens
gcgatccttgcccaaggtcacacagctagttagaagagagctcatctcctggttccaaatcctatgttcttttgataaaaacgtaatgcttcgtattatttaaaatataaggtttggccaaataagttgaagattagcttttccctcttgagtcagaggaaaataataaatctatttctgcagtattcttctattggcctgagctagcatttctgaaagtatgttgttccactgaatactatttttaaaatcagccaggcacagtggctcattcctgtaatcctagcactttgggaagccaaggtgggaggatcagttgagtccaggagtctgagaccagcctggtcaacataaggtgacccct

SEQ ID NO: 40743 - DNA, 369 bp, Homo sapiens
gcaatattatatctatgttatctcctttaactattatatcatttcctagtcccctaggcctgaaaactaccttattcttcaagaatcaccttactttccagcttttcgcacccaaagtcagccgaagcgtttcctgtgtgtgcactgtagcacctcatagttgttgctattctgactttattcggcattatatctccactaaactgggttctctttgatggcagtgtcgctagtgttgttattctggtatctcaaggcctctcttcacttgaatctatcacaatattttagaatatttagttgctgaaaatgatgtttaggtgaactcagtcctacaactatgaatcatatcttttgttttagctacca

SEQ ID NO: 40744 - DNA, 690 bp, Homo sapiens
ccgaacattattagatgttcctgtgggtaagtctctttcttaaccttactcttaatgaatgtcaggatatttgagttctagggattccatttgcagcataatagaatctgcaatcagaaaagcaggttttgaagtccaggtacaaaacctggagagttgcaggaatgaacttggatgaactacataccctgccagtgtcaatgggtaattcacacagaggcagctgtgagaggcaacaatgtatgtgaaggccctctgtgatctctctgcccctgggtttttgcctctgaactaagacagtactagatggatgggtccttaactcttcattcccatcttcaacattctatgactctgactctaagggtggaaattcaagtatcaaggacaagctgccagtagccgagcacagtggtatgtgcctgtagtcccagatactagggaggccaagaaaggaggatctcttgagctcaggagttcgagaccagcctgagaaaaatagacccttgtctcaaatataaaataataataaaaaaagaacaagctgctggggaagcaatttctgggcccggggctttaataaacattgcagaactggctaggcgcagtgacttacgcctgtagtcccagctctttgggagactgacgcaggtgaattgcttgaacccaggagctcgagaccagcctggg

SEQ ID NO: 40745 - DNA, 353 bp, Homo sapiens
actggagatatttctgaacaccagaacctttggttcaggaattgccaactcaactccttaggtatgcacagactgggatccaagcaggttctaccttctctttcagtcttcctgtctacctgcagcttaccaatataataccttctacaagcacatggatgatctgccaatatataatgtaaaaattattttaaaatgtactcctcacacttagtttcccggtctgcgaaatgatgtcagtcctcagatgtgaatatatatacatacaagtacacacatcatgggactgtgggtgcaaagagtcaaacctcagccaaggccggacacagtggctcacacctgtaatcccagca

SEQ ID NO: 40746 - DNA, 362 bp, Homo sapiens
cagacaccgagtgactgatgggagcatcatctgtaggactgctggggcaggtacggctgccccacttccctcccccaaccctccactgtgccactttagcttcccccctaggccgaagccagagagatctttccagtgaaaactcttggtttgatgggtacagacatgcagttaaatagaaggtacaagttctaatgctggacagcagagtagggcgattgtagctagcaacaatgtattgtatatttcaaattagctagaagagaggacttgaattattcccaacatggagaaatgataaatactcaaggtgatagatgccccaaataccctgacctgatcattccacattctatgcatgt

SEQ ID NO: 40747 - DNA, 428 bp, Homo sapiens
ttgcataaataataccgggagtgtcatgacataaaacaatgaagatttattacaaatttctctcatggattggaataataagacgagccaaactagtacaagttcctcctttggtagtgttattaaattggtaaactggaagaattagatagagtgtttcttgatttttagcagagcatatgatatccttgtgggcaagatgaaggagtatgatatagtctggtagatttatagttagtgtaactaccaactgtccctcaaaaatgctgaataatatcaaggtggacagaagtcttgagttgcacacttagatgttggccttgcactgcctttctgaacatttaatcgggaaatagaataaagatctggatggtgtgtgtttgtgtgtgagtgtgtgtataaaacaaaagaaagagaaaaaaaaaaaa

SEQ ID NO: 40748 - DNA, 543 bp, Homo sapiens
tttcttttttctactactagattaaacttggttcctgtgaatgtaaatgtaattttgtgaacatttaatgaggatctactttatgtcaagtgctctgcatagtgctgtctctaagctataaaatgaaccaagcatcattaaatgaaacctaacttatgtccttgaagctaattttcatttgagtaaaatttaagaatagtgaagacaacattgttgtggcttagcaaagccgtctggagatttcttattggtggctggaggtgctgcaggctctgtcttggttcttatggatggccgtatgcccctcagtttctatcctggtggttttctgtatttggggttcaatcaatatttgtcaaacctaattttgctttaaaaactgactacacacacgcacacacaaagtgatggaacattgaacttcaaatgtagcaggtggtctgtttgagtcagtgtgcttcttagtacgcaaaaatagatttgaattcagaaatctgtgtgccagttgttatgaaatttgcaattgagcaaatcaaggttcat

SEQ ID NO: 40749 - DNA, 1378 bp, Homo sapiens
cacacaagactcagtaggccctgactgatgtctcttacatgaatgtgactggtgcccccaggaggcagtcaccgtgctgtctctgccccacattgtccttatgtatgtttacatggatgtctccccagcagcttgaaccctggagagcaagaataatctgattttcctgggggccagcacccaaataagcctggcatgcagtggcctcaataaaatgtgactgtattgagtcattttctagggccccagatcccctggtgtcatggacttagtctttgccagcattctgtccatgtgttctctggtcttctctcacaatgctgcatccctgtcccatttttagggtccctgtctatcactggatgctgcagcttctgttcattactgttagtgtatcattcttcatgcctctgtttctgtgatggtctcatcatatgtgaaccatttgacctggcgtattgtgtactagtcaccgtcaccatctctccatatgtatctccctgtatttcgggcccattccctctatgtcaagagtaaatagaggcacagagactgatgagaaacgttcataacatgaaggtaagactcagggagacagagactttgtggaagtatctctgagggagtcccagacacaggcagagagggccacatatcgtgtgccagaggctgagagactgagagggatgacaggcttaggggaaaactcagagaggagagatgcacattcctagtgaaattgcacaggcttccagcatgctggagggaacagaaaaggcatgggcctgaattcaggctgcagagcctgactcctccctgtggctacttttgggacctaagataagtgactttcctgaacctccatgacctcctcatatgtaaaccagggacaggacccaccttgtgtagtgcctgacccaaagcctggccctgcacactgtctctgactcacagcaatcatcagcacctctctttgcctcctacttgctcagtctctgtcacaagaactggatctccatccccttgatgctctgagcatcttcacccatttggtcgttgagacatatctgtccatgtctgtctaaaaggggaggagatgagggagaaaaaagggaatctactcagagcctgtgtgtgctgcccagtctaccaaataatttatatacatctcagtcctcacacaaccatccctgttttatagaggaggaagtggcttagagaatgtaactgaccaaagtcacactgccaggaactggaagcactaggatttgacagcatatccaaatatgtcagcaatttcaataaacatgactgtactcaacaaaaaaaaacacaaaacaaaaacaccagaacaagacaaaaaacaagaaaggggcgc

SEQ ID NO: 40750 - DNA, 4936 bp, Homo sapiens
  misc_feature (3117)..(3117): n is a, c, g, or t
cacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattnggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttggggg

SEQ ID NO: 40751 - DNA, 3773 bp, Homo sapiens
  misc_feature (1954)..(1954): n is a, c, g, or t
caccatgctgtttgatgcttgctcatctttgctcgtattgctccctctgcctgagataccctttgccttgccctagcccatctgttcttggactttgaagggtggctgggtaggaaacagacaggtgtggtggtgggaagctcagctgtgggaagacgggcctccactgggatgaaggatgcatgttaggggaacctgcgggccaggttggcaggaacttgctgggccgggccaccagcaggctcacggtcttgcccctctcagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattnggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttggggg

SEQ ID NO: 40752 - DNA, 4767 bp, Homo sapiens
  misc_feature (3117)..(3117): n is a, c, g, or t
cacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattnggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgcgccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttggggg

SEQ ID NO: 40753 - DNA, 2786 bp, Homo sapiens
  misc_feature (2680)..(2681): n is a, c, g, or t
  misc_feature (2683)..(2683): n is a, c, g, or t
  misc_feature (2706)..(2706): n is a, c, g, or t
  misc_feature (2718)..(2718): n is a, c, g, or t
cacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtttttnntnttttttttctcttttctttgttnattcctgcttgntgctgtcctcttcgctccccctctatcccttgcttcggttcggctccccgaccacgtctgttgtgctg

SEQ ID NO: 40754 - DNA, 3094 bp, Homo sapiens
cacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgttctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttggggg

SEQ ID NO: 40755 - DNA, 379 bp, Homo sapiens
tagcatatttgacttcacgctggatgaaattcaaagtttaaaaaggtatcagtgagggacctagcacagaggtctgctctggagacagggagggaaccaagcagaaagccaagccctcagttaaaaggatccctgctgtgcaggtctgtctgaaggggctttttgcagtagagctttcagcataacatccctgttcccagagcaccacagccctcccctcttctccagccctccccaccttgccccatggttatccacactcaccatgctgtttgatgcttgctcatctttgctcgtattgctccctctgcctgagataccctttgccttgccctagcccatctgaaaactcaggaccctgcttcttccaggaaggctt

SEQ ID NO: 40756 - DNA, 4171 bp, Homo sapiens
  misc_feature (3117)..(3117): n is a, c, g, or t
cacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattnggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagtcctcatgaaacatcctatcatctggccggtcgtggggcccggtacccaattcacccttagag

SEQ ID NO: 40757 - DNA, 4717 bp, Homo sapiens
  misc_feature (3117)..(3117): n is a, c, g, or t
cacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattnggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccgccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttggggg

SEQ ID NO: 40758 - DNA, 3454 bp, Homo sapiens
  misc_feature (3117)..(3117): n is a, c, g, or t
  misc_feature (3437)..(3437): n is a, c, g, or t
cacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattnggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcgagctagacngatcctctagataccca

SEQ ID NO: 40759 - DNA, 2967 bp, Homo sapiens
  misc_feature (140)..(140): n is a, c, g, or t
  misc_feature (788)..(788): n is a, c, g, or t
  misc_feature (828)..(828): n is a, c, g, or t
agcagcccaggggccttcctgcctggacgcaggaccacggagacctgcatgtgcagggaggcctggcagcctgccgatgggggtccccgagccccggagtctcctcgaaacccctgctgtgggtcacagcatggaccagnaggggtcaccatcctgagtacccccgacatccctgccccttgacctgtggcagatgctcctgccctggcctccaggaagtcagctcttttgcaaagggcttgtgtgagaggtcggagaaagccctgggcctccagggagatgcagctggcaggaggtgggctgagctgctccggggctaggggtggcccattgctggcagaatttaaggaaagagcaggttgtaggcacagaggatgggcagccaggcctgggccttccccttactgtcccagggcagcagagctagggtcctcttttaccctccctaaggtcacccccttcccatctacacgtccctccccaagttcaagcacatagtcaatcatgaccactcaggagctcagtgagctggggccatgtccctgtggcctccagcccatccgcaggagggtcccttgcagtgacagcacaaagagtcccccacaggaagcccctgagggccagcatggaccttgagagccaggagggaatgggcctggtgccactctgttcccactcccacctaagattcctacccctgtgttctagcaggtgactcttgatctggccagcccacaacaaatacttgaactaggcagcatggggtggtggaggcctgcagaggcccngggcccaggaactgagactagggctttctcatgaggcctnatcaagctcccgcaggtatgacctggcctcctcgcctcgggctgccttaaagcaccgctaacccacgccaaggggctaggcagggcttcgcggggcctggcccaaggtctccagcagagcaataacatcttcccaggttgggttgccacagacaccctgccctggagcccccagcccatcccatctggtgctaccctgtctgcctggcagcctagcctcacccctcctgtccggtcatctgggggtccttggtaaggatgcagccacatggggccggtttatgcacctgggcgagaacctgactggggcaggggatgctcaggggcctgcaggtctcccacagagctgcttttctgcccgcctcaccctgtgggtttgtatttcttgccgggtcaaaataggcagtgactcgtgccttccctcctcagggccggcggcagggtgtggacccagctggccgctggaccgtccccttcctcattctccaagctcatcaacaggtctcagaggaacatttccataaaaggtgtggcctggcatgcagtgctgtctgcacgctgtcgcttcccccacagcaacctgccggtcagccttaactggtgtggaggtcgaggtggggagggggaggcgggcttccctccctggtgtctggcctctttttgctcagccctcagcacagccttcagcgtggagagcgagaccctgcgtgtcactggggcttggctgaggtctccctgcaggataacagtgacttcaggaacccagaccccagtctgggcggctctaccttcccggctggcccagcccccacaccacagttccctgccacctccaggcacaaaagcctctgaggccacagcccagctatgaagctgagtggctttgtgcggtctcctagggaaggggcagtgatgccatgcatgagatccgctgtgccataagaagttgcttcctttagaatttctggtccaatgcagggaggtgaggcccagcctcatgataacacatgcccatcaaggaaaagctgtggctaatgcttccaaaacaagtgaaaatcttgcaccaggcccagggccatatctcattccgccccagctactgagggaggggacagactgctggaggacaatttctcctagttaccactaggggttacatggctactcagaatgaaagataaattgccaggcctgttgcaatcttttttttgagatgggagtcttgctctgtcgcccaggctggagtgcagaggtgcgatctcagctcactgcaacctccacctcccgggtcaagcaattctcctgcctcagcttcccgagtagctggaattacaggtgcccaccaccatgcctggctaatttttgtatttttagtagagacggggtttcaccatgttggccaggctggtcttgaacacctgacctcaaatgatccgcccacctcggcctcccaaagtgttgggattacaggcgtgagccacctcaccaggccccgttgcaatcttactccacttcgttttcacagcagtcccgggacatgcccattattaggcctatttgatagatgatactgaggctcagagtcgggggtcacaagccaaagccacaccgctagaagggctcaggacccaagcccagctcccgtcctcttggtggcatcaagcttgtgtgatatgaggtcttatgtctgctcatgacagccttaaaagcaataaacagatacaacttccagcaacttcccactcagctgcaaggctgcgggggggtcctgcctcgagccataaggtgagcagctagccagtgccgggccagtgtggagaaggctgaattgcctgtgaagctggggttgcaggcaggaatattcatggagcccctgaccatgtactcacactgctcttcctcagttcagggttcttggatttgctcaagtccacccaaatatccctttacgattctcagggtcccactccttccagatccaatgccctaaactttacataagagttccggcaaggctgtgacttcaacttgtgttgtaactgcaacctgcagaatcaaatttagggttatgttttcagttgtatcagtcttacggctacaagatattaaagagattcttttctggttatcaaaaaaaatc

SEQ ID NO: 40760 - DNA, 2611 bp, Homo sapiens
  misc_feature (612)..(612): n is a, c, g, or t
  misc_feature (652)..(652): n is a, c, g, or t
ccatgagagcacatgcgttgtgtgaggagatgcgtggagagaggagattcgcggtgtgaggagttgtgtgagaggtcggagaaagccctgggcctccagggagatgcagctggcaggaggtgggctgagctgctccggggctaggggtggcccattgctggcagaatttaaggaaagagcaggttgtaggcacagaggatgggcagccaggcctgggccttccccttactgtcccagggcagcagagctagggtcctcttttaccctccctaaggtcacccccttcccatctacacgtccctccccaagttcaagcacatagtcaatcatgaccactcaggagctcagtgagctggggccatgtccctgtggcctccagcccatccgcaggagggtcccttgcagtgacagcacaaagagtcccccacaggaagcccctgagggccagcatggaccttgagagccaggagggaatgggcctggtgccactctgttcccactcccacctaagattcctacccctgtgttctagcaggtgactcttgatctggccagcccacaacaaatacttgaactaggcagcatggggtggtggaggcctgcagaggcccngggcccaggaactgagactagggctttctcatgaggcctnatcaagctcccgcaggtatgacctggcctcctcgcctcgggctgccttaaagcaccgctaacccacgccaaggggctaggcagggcttcgcggggcctggcccaaggtctccagcagagcaataacatcttcccaggttgggttgccacagacaccctgccctggagcccccagcccatcccatctggtgctaccctgtctgcctggcagcctagcctcacccctcctgtccggtcatctgggggtccttggtaaggatgcagccacatggggccggtttatgcacctgggcgagaacctgactggggcaggggatgctcaggggcctgcaggtctcccacagagctgcttttctgcccgcctcaccctgtgggtttgtatttcttgccgggtcaaaataggcagtgactcgtgccttccctcctcagggccggcggcagggtgtggacccagctggccgctggaccgtccccttcctcattctccaagctcatcaacaggtctcagaggaacatttccataaaaggtgtggcctggcatgcagtgctgtctgcacgctgtcgcttcccccacagcaacctgccggtcagccttaactggtgtggaggtcgaggtggggagggggaggcgggcttccctccctggtgtctggcctctttttgctcagccctcagcacagccttcagcgtggagagcgagaccctgcgtgtcactggggcttggctgaggtctccctgcaggataacagtgacttcaggaacccagaccccagtctgggcggctctaccttcccggctggcccagcccccacaccacagttccctgccacctccaggcacaaaagcctctgaggccacagcccagctatgaagctgagtggctttgtgcggtctcctagggaaggggcagtgatgccatgcatgagatccgctgtgccataagaagttgcttcctttagaatttctggtccaatgcagggaggtgaggcccagcctcatgataacacatgcccatcaaggaaaagctgtggctaatgcttccaaaacaagtgaaaatcttgcaccaggcccagggccatatctcattccgccccagctactgagggaggggacagactgctggaggacaatttctcctagttaccactaggggttacatggctactcagaatgaaagataaattgccaggcctgttgcaatcttttttttgagatgggagtcttgctctgtcgcccaggctggagtgcagaggtgcgatctcagctcactgcaacctccacctcccgggtcaagcaattctcctgcctcagcttcccgagtagctggaattacaggtgcccaccaccatgcctggctaatttttgtatttttagtagagacggggtttcaccatgttggccaggctggtcttgaacacctgacctcaaatgatccgcccacctcggcctcccaaagtgttgggattacaggcgtgagccacctcaccaggccccgttgcaatcttactccacttcgttttcacagcagtcccgggacatgcccattattaggcctatttgatagatgatactgaggctcagagtcgggggtcacaagccaaagccacaccgctagaagggctcaggacccaagcccagctcccgtcctcttggtggcatcaagcttgtgtgatatgaggtcttatgtctgctcatgacagccttaaaagcaataaacagatacaacttccagcaacttcccactcagctgcaaggctgcgggggggtcctgcctcgagccataaggtgagcagctaatccaatgccctaaactttacataagagttccggcaaggctgtgacttcaacttgtgttgtaactgcaacctgcagaatcaaatttagggttatgttttcagttgtatcagtcttacggctacaagatattaaagagattcttttctggttatcaaaaaaaatc

SEQ ID NO: 40761 - DNA, 2791 bp, Homo sapiens
  misc_feature (612)..(612): n is a, c, g, or t
  misc_feature (652)..(652): n is a, c, g, or t
ccatgagagcacatgcgttgtgtgaggagatgcgtggagagaggagattcgcggtgtgaggagttgtgtgagaggtcggagaaagccctgggcctccagggagatgcagctggcaggaggtgggctgagctgctccggggctaggggtggcccattgctggcagaatttaaggaaagagcaggttgtaggcacagaggatgggcagccaggcctgggccttccccttactgtcccagggcagcagagctagggtcctcttttaccctccctaaggtcacccccttcccatctacacgtccctccccaagttcaagcacatagtcaatcatgaccactcaggagctcagtgagctggggccatgtccctgtggcctccagcccatccgcaggagggtcccttgcagtgacagcacaaagagtcccccacaggaagcccctgagggccagcatggaccttgagagccaggagggaatgggcctggtgccactctgttcccactcccacctaagattcctacccctgtgttctagcaggtgactcttgatctggccagcccacaacaaatacttgaactaggcagcatggggtggtggaggcctgcagaggcccngggcccaggaactgagactagggctttctcatgaggcctnatcaagctcccgcaggtatgacctggcctcctcgcctcgggctgccttaaagcaccgctaacccacgccaaggggctaggcagggcttcgcggggcctggcccaaggtctccagcagagcaataacatcttcccaggttgggttgccacagacaccctgccctggagcccccagcccatcccatctggtgctaccctgtctgcctggcagcctagcctcacccctcctgtccggtcatctgggggtccttggtaaggatgcagccacatggggccggtttatgcacctgggcgagaacctgactggggcaggggatgctcaggggcctgcaggtctcccacagagctgcttttctgcccgcctcaccctgtgggtttgtatttcttgccgggtcaaaataggcagtgactcgtgccttccctcctcagggccggcggcagggtgtggacccagctggccgctggaccgtccccttcctcattctccaagctcatcaacaggtctcagaggaacatttccataaaaggtgtggcctggcatgcagtgctgtctgcacgctgtcgcttcccccacagcaacctgccggtcagccttaactggtgtggaggtcgaggtggggagggggaggcgggcttccctccctggtgtctggcctctttttgctcagccctcagcacagccttcagcgtggagagcgagaccctgcgtgtcactggggcttggctgaggtctccctgcaggataacagtgacttcaggaacccagaccccagtctgggcggctctaccttcccggctggcccagcccccacaccacagttccctgccacctccaggcacaaaagcctctgaggccacagcccagctatgaagctgagtggctttgtgcggtctcctagggaaggggcagtgatgccatgcatgagatccgctgtgccataagaagttgcttcctttagaatttctggtccaatgcagggaggtgaggcccagcctcatgataacacatgcccatcaaggaaaagctgtggctaatgcttccaaaacaagtgaaaatcttgcaccaggcccagggccatatctcattccgccccagctactgagggaggggacagactgctggaggacaatttctcctagttaccactaggggttacatggctactcagaatgaaagataaattgccaggcctgttgcaatcttttttttgagatgggagtcttgctctgtcgcccaggctggagtgcagaggtgcgatctcagctcactgcaacctccacctcccgggtcaagcaattctcctgcctcagcttcccgagtagctggaattacaggtgcccaccaccatgcctggctaatttttgtatttttagtagagacggggtttcaccatgttggccaggctggtcttgaacacctgacctcaaatgatccgcccacctcggcctcccaaagtgttgggattacaggcgtgagccacctcaccaggccccgttgcaatcttactccacttcgttttcacagcagtcccgggacatgcccattattaggcctatttgatagatgatactgaggctcagagtcgggggtcacaagccaaagccacaccgctagaagggctcaggacccaagcccagctcccgtcctcttggtggcatcaagcttgtgtgatatgaggtcttatgtctgctcatgacagccttaaaagcaataaacagatacaacttccagcaacttcccactcagctgcaaggctgcgggggggtcctgcctcgagccataaggtgagcagctagccagtgccgggccagtgtggagaaggctgaattgcctgtgaagctggggttgcaggcaggaatattcatggagcccctgaccatgtactcacactgctcttcctcagttcagggttcttggatttgctcaagtccacccaaatatccctttacgattctcagggtcccactccttccagatccaatgccctaaactttacataagagttccggcaaggctgtgacttcaacttgtgttgtaactgcaacctgcagaatcaaatttagggttatgttttcagttgtatcagtcttacggctacaagatattaaagagattcttttctggttatcaaaaaaaatc

SEQ ID NO: 40762 - DNA, 354 bp, Homo sapiens
taaaatgcaagtcattgtagagatgccagtctatgcctttatgcttgccagtctcaattaagacttgattgagctgcagtactttaaaaaggattagaagagctattgaatgacttaatttattagaagtttttaagtgacagcatttctaattattcaagtgcatttatttttcatgaaaaaaggtagaatgatttgttctgacataaagtaaatagtgttgatgcattagaaattgtgtgtcttgattatgatttctgtactttttgcattagaagtataatggacttgtatttttaaatagttgaaactagcactgtgatcatattaaataatgcatttctcagtttggac

SEQ ID NO: 40763 - DNA, 451 bp, Homo sapiens
ctttatcagcctacaatggagaatttccaaagccttcaaagcatgttaagacaacctagagaattatagaaaaacgtttgaattaacttgcttttggatcaatttttctttgggacaggggtttgcaaactatgaccaatagaacaaagccagactcattcgcaaattgctctctgatttcaatacagcagcagagttgagtggctgtgacagagaccgcatggcctgcaaagcctaaaatagttactctctggtcttttatagaaaaagttcgctgatctctattctatgatacatacatagattccaaaggcttacattggtatgaatttaaaaaataaaaataggccgggtgtggtggctcacgcctgtaatcccagcactttgggaggccgaggtgggcggatcacgaggtcaggagatcgagaccatcctggctaacatgatgaaa

SEQ ID NO: 40764 - DNA, 1128 bp, Homo sapiens
ttttttttttatctttttctttagggacattggtctatagttagtatctaggtttacaacattaagcttttttcattttgtttggaaaaacaaggctggcagaattacatttgtttttaattccattgctaatattacatacttaggaggctatcaggtgcaagttatttacttgagacaagaagcactgattattttggctaggcttcatctgaaggcctatgttctgggaagggaggcctccataaaaaaggaagaacctttagtgacctttatccttgggaataaaagtaaagatcagaagccagtgcattcagtttaccgtcttacaaaaggagtcaagtattgtataggtcagagaccactattgtaagatcatataaatcctgtgtctaattttgttatcctctgtttctccataataattagtaccaagcactttacaaaaagaatccccatatatttgtttttggaggccacaagaaatgggaagggctaatgagagactgcagttaattctgcagctagtcttagggaaaacagaactccaaaaaatagaagagctgaaaggagaagaaagcagactgaattcttgtgcttatcaaaggaagaacaaaagaataaggagttgtcctggatctgagaccattagtggggttacctgagatgacctgtgatgtgtgtggcactgtgttttttttatgtgaactagagcaagaaattagatatggcccctcctgtaaagaaactcactcatttgtggggaaaatatataaggaaacaactcttcataacctaaggtttaataatattagtgttataatagtgaaggagacagatcttagctattctgatgggaagtttacattttagttgagtttgggaggataaataaaatttcattgggaagaaaagaattttctagttgagaagtcatttatttataccttttcctaccttctcccagtccattaccaaatcatgttaattttgcctccaaagtatatctcgagtcttcctatcttcattgctactaggctagttcactctgtagtttttttacatgagctatgttgatggcctttggccttctaatcagcctgttttcattattgcctcctcctccta

SEQ ID NO: 40765 - DNA, 383 bp, Homo sapiens
ccagagactgccagtggattagtttgatcctatgtgaggaaaaaagctgctttgtgaaaccagtaattccatagagactagtggtattagagatatttttaaatttggggcttagccagaagatctgagcattgatataccctttcctttctgtattaatgaatttaaaatatgttgttgatttaatgtttagtttgtacattgatttctggtttgggcttctttaaactttgtgtgaatattagaatccagtgagtttgttaaaaaatatttgcttattctatcctttcatatgacatatactagtagaagacagctattattttgaaagcagcatatatatttaacattcttatgattgtacagatgtggactggcatgag

SEQ ID NO: 40766 - DNA, 407 bp, Homo sapiens
gctttatgaccttgccagctggaccacaaccaagcttcttacacagagtgagtcaaaactaatccatcctctctattagaaagggttatgaactgtccccaaccacaacactttcagaagacaaatttggaagagcctctttcaagagaccaccatcagttaggaagggttggtgcctttcaaagactgctccattcaataccagtcatctcaaagagtaggggcaattttcatcccctattgtcaaccatctataacacagtcactgcaacatgaaagagaaagaaggttattcctttgcatagatgcttgtgaacataatcatcagagagcaaatatatggtgaggcagaacttagcacatcaaattcatgacatgcaataggttggttaccctcaatcagaaac

SEQ ID NO: 40767 - DNA, 381 bp, Homo sapiens
aatggggccagactctctgggctaaagtcccctccatgcactctatgtaagtattagattgttatcatcaagcgctttgccccaggtgcacagctggggagtggcagggctggatctctgatgtcctgatacagaagtgagtaatactctatatctacccacctggggctcatagactggggtgactgggtaggcacaggaacctgggctccagaggggggtgcctggtctttttagttcaagatttctgccaggcagtggaacaggcaggcaggtggaccttgagtcctattgatgccctagttgggtgcacttaattagagtcactgggaggcatttgaggtacgtgctgtacccagaattcctcagcttgcacagctt

SEQ ID NO: 40768 - DNA, 410 bp, Homo sapiens
atttttactatgcatggtacccatgagcctaaataagtagcatagtagtaacagttttcaaactgcagtatgagagagtttactcacttatagaactacttcagtcttgattgtctagggataatggacaagaggactgtgaaatgaagattaactatttaatggcctgtgaaaagacggtgttagataattattaagcaaagaacttccactacaagccagacttaaccctcttctgatttattgctcacctattacagttgaattctaattacagtatgaatagctgaagtttgaaagcctgcttttcaagtttgagagtttttaaaagtccagttctttcaggatgaatttagcggaattaacctctctcatgattttacctgattttgtgaacatgcctagttttg

SEQ ID NO: 40769 - DNA, 384 bp, Homo sapiens
tacaaggtctagtgtttattccagtcctgctaataacctgtaacatgccagtctgggacaggggactgcttttgttctcctaactcataaaatgttaacacatttggccaggcacagtggctcacgtctctaatcctagcactttgggagaccgaggtgagtggatcactgaggtcaggagtttgagaccagcctggccaacatggtgaaacttggtctctactaaaaatacaaaaattagctgggcatggtggcacatgcctgtggtcccagctacttgggaggctgaggcaggagaatcggttgaactcaggaggtggaggtacagtgagccgagatcatgccactgcactcctgcctgggagacagagcaacactctgtct

SEQ ID NO: 40770 - DNA, 557 bp, Homo sapiens
  misc_feature (547)..(549): n is a, c, g, or t
  misc_feature (551)..(556): n is a, c, g, or t
aagaagtgcctttcacctctcatcatgattctgtggcctccccagccatgtggaacttttttctcttgctgctaccatgtaagaagtgcctttcacctcgtgccatgattatgagacttccccagccatgtggaactgttaagtccaattaaacatctttttcttcttagtcccaggttgttctcattcgtggctggatcacaccagcaagaaggattttaaaggacaactccttggggccgtccaacactgaaaccgcctgaccgctgctgtctttgtgcttgcagaaaatcacggtgggcacaaaattttggacacgatttcgagagcgtgagagctactgttcacgaatccagggccagcctcgtgtctgtcttcctttaaagcacctggcttggtacctaaaatgttcctttttttttttttttgaaattcaataacttcatcagaacaggcgttgatgtagacagatctccatctttttggttttttgagtgagtttttgctctgtaggctgaattctttggaatttagttctgaaatcacnnnannnnnna

SEQ ID NO: 40771 - DNA, 412 bp, Homo sapiens
caaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctga

SEQ ID NO: 40772 - DNA, 2229 bp, Homo sapiens
atcagggcggcgggcgagggcggggcgagggcggggaggtgggcggggacggggcccgcacggcggctacggcctaggtgagcggctcggactcggcggccgcacctgcccaacccaacccgcacggtccggaagtcgccgaggggccgggagcgggaggggacgtcgtcctagagggccggagcgggcgggcggccgaggacccggctcccgcgcaggacggagccgtggctcaggtcggcccctccccaacaccaccccgggcctccgccccttcctgggcctctcggtggagcagggacccgaaccggtgcccatccagtccggtgccatctgaagcccccttcccagaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgtgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcagccacggctccccctcggcctattacacgcgtgcgcagccaggcctcgccagggtgcggtgcagagcagagcaggcaggggtgggggccgggcccgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaacccccagcacacacacaacaacac

SEQ ID NO: 40773 - DNA, 2899 bp, Homo sapiens
gggaaaggcctggaggtgtctgggtcaccttcctgggctggcaagctgcctgcctcctgcacagccactgcccttcctgttgttcccgagccaccagccacagctctgagaagctcctggcagcttctgtttgccactggctcgaatctgggcaggaaggcaaggcccgcagaatatctggtgaccaagaaggaaaccccagagcctcagagaccatcttctcagtggacaaaattaaggcccgaggaggggaggggcgtgctggaagtctatgggactgcatctttctgaggcccaggagcagccatcccccacacctgaagcccggtgagctcacatctggggcctccgcctggtgccaagcatgcaacccaacctgtggggcctgcaacgccaggcttcagcaccctgcaggcaccagtgctccagcagcctgggccacgggctgggcagggcttgcagcccatgatccctagtgatgaagggcccagtcctagggtgctgagcaacctgcccacctgctcctggccaggagctctcaccacggctgggtgcccttccccctcccccaccgatggagtccctgcagccagggaggccaggacagggctcccagcaccaaccggcctaggaacccccaggccctcttcctggtcgaggtggaatgcagctgactctcaggttccccagagcagaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgtgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcagccacggctccccctcggcctattacacgcgtgcgcagccaggcctcgccagggtgcggtgcagagcagagcaggcaggggtgggggccgggcccgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaaaaaaaaaaaaaaaaaaaaaaaaaaaaaaaaaaaaaaaaaaaaaaaaaaaaaaaaaaaaaaaaagggggggggcccaaaaaaacccccgagggggggcccgaacagtcgatcgcacgcacccgccccggtgttttttgtgagggaagaagagacggcgcgccccaataaagagagaccggctagcgaatatataaacccgcagtccggcagcgcccgccgtgcgtaaaccaacgaccacgcagcagtagtcgagaaacaaaggcgcaaaacgagagctcgtagtggagaaggcgcacccacacacgggggggggaaaaaagggcgcacgcaaccccacagagataagcacg

SEQ ID NO: 40774 - DNA, 1246 bp, Homo sapiens
tcgaggatatgcagggagatctggacgggttgcagtgacgattttgatgtaggaagtgtgtggggaggctgtggcccgaaagaggccgaagggacagcacccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaaaaaaaaaaaaaaaaaaaaaaaaaaaaaaaaaaaaaaaaaaaaaaaaaaaaaaaaaaaaaaaaagggggggggcccaaaaaaacccccgagggggggcccgaacagtcgatcgcacgcacccgccccggtgttttttgtgagggaagaagagacggcgcgccccaataaagagagaccggctagcgaatatataaacccgcagtccggcagcgcccgccgtgcgtaaaccaacgaccacgcagcagtagtcgagaaacaaaggcgcaaaacgagagctcgtagtggagaaggcgcacccacacacgggggggggaaaaaagggcgcacgcaaccccacagagataagcacg

SEQ ID NO: 40775 - DNA, 489 bp, Homo sapiens
gcccagaagaggcccaccctctcggtccggaacaagacgcctcagccacgccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaacccccagcacacacacaacaacac

SEQ ID NO: 40776 - DNA, 2555 bp, Homo sapiens
atcagggcggcgggcgagggcggggcgagggcggggaggtgggcggggacggggcccgcacggcggctacggcctaggtgagcggctcggactcggcggccgcacctgcccaacccaacccgcacggtccggaagtcgccgaggggccgggagcgggaggggacgtcgtcctagagggccggagcgggcgggcggccgaggacccggctcccgcgcaggacggagccgtggctcaggtcggcccctccccaacaccaccccgggcctccgccccttcctgggcctctcggtggagcagggacccgaaccggtgcccatccagtccggtgccatctgaagcccccttcccagaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgtgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcagccacggctccccctcggcctattacacgcgtgcgcagccaggcctcgccagggtgcggtgcagagcagagcaggcaggggtgggggccgggcccgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaaaaaaaaaaaaaaaaaaaaaaaaaaaaaaaaaaaaaaaaaaaaaaaaaaaaaaaaaaaaaaaaagggggggggcccaaaaaaacccccgagggggggcccgaacagtcgatcgcacgcacccgccccggtgttttttgtgagggaagaagagacggcgcgccccaataaagagagaccggctagcgaatatataaacccgcagtccggcagcgcccgccgtgcgtaaaccaacgaccacgcagcagtagtcgagaaacaaaggcgcaaaacgagagctcgtagtggagaaggcgcacccacacacgggggggggaaaaaagggcgcacgcaaccccacagagataagcacg

SEQ ID NO: 40777 - DNA, 2358 bp, Homo sapiens
atcagggcggcgggcgagggcggggcgagggcggggaggtgggcggggacggggcccgcacggcggctacggcctaggtgagcggctcggactcggcggccgcacctgcccaacccaacccgcacggtccggaagtcgccgaggggccgggagcgggaggggacgtcgtcctagagggccggagcgggcgggcggccgaggacccggctcccgcgcaggacggagccgtggctcaggtcggcccctccccaacaccaccccgggcctccgccccttcctgggcctctcggtggagcagggacccgaaccggtgcccatccagtccggtgccatctgaagcccccttcccaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgtgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcagccacggctccccctcggcctattacacgcgtgcgcagccaggcctcgccagggtgcggtgcagagcagagcaggcaggggtgggggccgggcccgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaaaaaaaaaaaaaaaaaaaaaaaaaaaaaaaaaaaaaaaaaaaaaaaaaaaaaaaaaaaaaaaaagggggggggcccaaaaaaacccccgagggggggcccgaacagtcgatcgcacgcacccgccccggtgttttttgtgagggaagaagagacggcgcgccccaataaagagagaccggctagcgaatatataaacccgcagtccggcagcgcccgccgtgcgtaaaccaacgaccacgcagcagtagtcgagaaacaaaggcgcaaaacgagagctcgtagtggagaaggcgcacccacacacgggggggggaaaaaagggcgcacgcaaccccacagagataagcacg

SEQ ID NO: 40778 - DNA, 2531 bp, Homo sapiens
gggaaaggcctggaggtgtctgggtcaccttcctgggctggcaagctgcctgcctcctgcacagccactgcccttcctgttgttcccgagccaccagccacagctctgagaagctcctggcagcttctgtttgccactggctcgaatctgggcaggaaggcaaggcccgcagaatatctggtgaccaagaaggaaaccccagagcctcagagaccatcttctcagtggacaaaattaaggcccgaggaggggaggggcgtgctggaagtctatgggactgcatctttctgaggcccaggagcagccatcccccacacctgaagcccgaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgtgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcagccacggctccccctcggcctattacacgcgtgcgcagccaggcctcgccagggtgcggtgcagagcagagcaggcaggggtgggggccgggcccgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaaaaaaaaaaaaaaaaaaaaaaaaaaaaaaaaaaaaaaaaaaaaaaaaaaaaaaaaaaaaaaaaagggggggggcccaaaaaaacccccgagggggggcccgaacagtcgatcgcacgcacccgccccggtgttttttgtgagggaagaagagacggcgcgccccaataaagagagaccggctagcgaatatataaacccgcagtccggcagcgcccgccgtgcgtaaaccaacgaccacgcagcagtagtcgagaaacaaaggcgcaaaacgagagctcgtagtggagaaggcgcacccacacacgggggggggaaaaaagggcgcacgcaaccccacagagataagcacg

SEQ ID NO: 40779 - DNA, 2017 bp, Homo sapiens
atcagggcggcgggcgagggcggggcgagggcggggaggtgggcggggacggggcccgcacggcggctacggcctaggtgagcggctcggactcggcggccgcacctgcccaacccaacccgcacggtccggaagtcgccgaggggccgggagcgggaggggacgtcgtcctagagggccggagcgggcgggcggccgaggacccggctcccgcgcaggacggagccgtggctcaggtcggcccctccccaacaccaccccgggcctccgccccttcctgggcctctcggtggagcagggacccgaaccggtgcccatccagtccggtgccatctgaagcccccttcccagaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgtgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcagccacggctccccctcggcctattacacgcgtgcgcagccaggcctcgccagggtgcggtgcagagcagagcaggcaggggtgggggccgggcccgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggcaccagttccccgagggacgcagcaggccgcctcccgcagcggccgtgggtctgcacagcccagcccagcccaaggcccccaggagctgggactctgctacacccagtgaaatgctgtgtcccttctcccccgtgccccttgatgccccctccccacagtgctcaggagacccgtggggcacggaacaggagggtctggaccctgtggatcctaaatctccgggccgtaccagcctgctt

SEQ ID NO: 40780 - DNA, 2045 bp, Homo sapiens
atcagggcggcgggcgagggcggggcgagggcggggaggtgggcggggacggggcccgcacggcggctacggcctaggtgagcggctcggactcggcggccgcacctgcccaacccaacccgcacggtccggaagtcgccgaggggccgggagcgggaggggacgtcgtcctagagggccggagcgggcgggcggccgaggacccggctcccgcgcaggacggagccgtggctcaggtcggcccctccccaacaccaccccgggcctccgccccttcctgggcctctcggtggagcagggacccgaaccggtgcccatccagtccggtgccatctgaagcccccttcccagaaaatgagccacagagcaagctgaccccagcgacacagccccccagccctactgtatttccgttcctatcaaaaaatggatgactcggagacaggtttcaatctgaaagtcgtcctggtcagtttcaagcagtgtctcgatgagaaggaagaggtcttgctggacccctacattgccagctggaagggcctggtcaggtttctgaacagcctgggcaccatcttctcattcatctccaaggacgtggtctccaagctgcggatcatggagcgcctcaggggcggcccgcagagcgagcactaccgcagcctgcaggccatggtggcccacgagctgagcaaccggctggtggacctggagcgccgctcccaccacccggagtctggctgccggacggtgctgcgcctgcaccgcgccctgcactggctgcagctgttcctggagggcctgcgtaccagccccgaggacgcacgcacctccgcgctctgcgccgactcctacaacgcctcgctggccgcctaccacccctgggtcgtgcgccgtgccgtcaccgtggccttctgcacgctgcccacacgcgaggtcttcctggaggccatgaacgtggggcccccggagcaggccgtgcagatgctaggcgaggccctccccttcatccagcgtgtctacaacgtctcccagaagctctacgccgagcactccctgctggacctgccctagaggcgggaagccagggccgcaccggctttcctgctgcagatctgggctgcggtggccagggccgtgagtcccgtggcagagccttctgggcgctgcgggaacaggagatcctctgtcgcccctgtgagctgagctggttaggaaccacagactgtgacagagaaggtggcgaccagcccagaagaggcccaccctctcggtccggaacaagacgcctcagccacggctccccctcggcctattacacgcgtgcgcagccaggcctcgccagggtgcggtgcagagcagagcaggcaggggtgggggccgggcccgcaagagcccgaaaggtcgccaccccctagcctgtggggtgcatctgcgaaccagggtgaagtcacaggtcccggggtgtggaggctccatcctttctcctttctgccagccgatgtgtcctcatctcaggcccgtgcctgggaccccgtgtctgcccaggtgggcagccttgagcccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaacccccagcacacacacaacaacac

SEQ ID NO: 40781 - DNA, 1084 bp, Homo sapiens
  misc_feature (504)..(504): n is a, c, g, or t
  misc_feature (568)..(568): n is a, c, g, or t
cgggcccggtgagtccccggttgtccaagaagcgtttcctggggcgacagccgggaaacagggagatccgttctggtggccccctgttaagctggaagcctagcgttaggaacgcacaggactgtgacaggagaaaggctggcgaaccagccccagaaaggagcgcccgaccgctgcgtcggttccgggaatcaagaccgccttcaagcccacaggcgtcgcccgtctggcgcatacttaacacggcggtgccgctagtcctaggggcctccgtccaagtggtcgacggttgcaagagtcaagaaggcaagggcagtggggcttgggggaccggggccacggccaaagtagcgccagataagcatacggccaagccgctccttagcccatgtcgggggctcgcatccctagcgaacccaacgggctgaagtgccacaagggtcccgggcgtgtagtgaaaggcgtcctatgccatttgcgtccgtctatcgtggccaagccgantggtagtcgcatcaatctgcacggccgcagtagcacttgcgggaccaccgttgatcgtgtcacncaaggtaggggaacaagcccgtgtgaagacacccaggggactcagtgccctccatgccctggctggcagaaaccctcaacagcagtctgggcactgtggggctctccccgcctctcctgccttgtttgcccctcagcgtgccaggcagactgggggcaggacagccggaagctgagaccaaggctcctcacagaagggcccaggaagtccccgcccttgggacagcctcctccgtagcccctgcacggaacaggagggtctggaccctgtggcccagccaaaggctaccagacagccacaaccagcccagccaccatccagtgcctggggcctggccactggctcttcacagtggaccccagcacctcggggtggcagagggacggcccccacggcccagcagacatgcgagcttccagagtgcaatctatgtgatgtcttccaacgttaataaatcacacagcctcccaggagggagacgctggggtgcaacccccagcacacacacaacaacac

SEQ ID NO: 40782 - DNA, 1541 bp, Homo sapiens
ttttttttttaatttaatcagtaactttattataacaaaacctgtatattacccatttaaactcatgtgtaacattcagtgatgtgagctgtattaaacccaggtattagtgaaaatttgcattgtaaaacctggtaacagtagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggcgcctctagactcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttgattggcag

SEQ ID NO: 40783 - DNA, 473 bp, Homo sapiens
ggggggccggaaggggctgggaggatctgacggggagccagcctcagggagccccaaaggaggtacccccaaatctcaggtaaggcacctgtgggagggttgggtcccagaaggctaaggcctgctcacccgccaacctctcccccctcccccaggcgcctctagactcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaa

SEQ ID NO: 40784 - DNA, 2332 bp, Homo sapiens
ggtggaggctatcaccgagggtgtggaggaggacgagggctgttgctgctgtgaacctggccacctgccacgggtcctgtccttcaatgctgcctttgggcagcgctggctggcttgggaggtaacagccagcaagtacgtgctggagggctatagcattagtgacaataatgctgcctccatgctgcaggttttcgacctccgcaagatcctcatcacctactatgtcaagagcatcatctactacgtgagccgctcaccaaagctggaggtgtggctcagccatgagggcatcacggcagccctgaggcctgtgcgggtgcccggctatgccgactcggatcccaccttctcgctgagtgtggatgaggactatgacctccgcctgtctggcctctcgctgccctccttttgtgctgtgcacctcgagtggatccagtactgcgcctcccggcgcagccagcccgtggaccaggattggaactccccgctggtcacgctgtgttttggcctgtgtgtgctgggccgccgggccctgggacagcctctcacagcatgtctgcaagcctggagcccttcctctacggcctgcacgccctgttcaagggggattttcgcatcacctccccacgtgacgagtgggtctttgccgacatggacctgcttcaccgcgttgtggcgcctggggttcgcatggccctcaagcttcaccaggaccacttcacgtccccagatgaatatgaggagccagcagccctatacgatgccattgcggccaacgaggagcggctggtcatctcacatgagggtgacccagcatggcgcagcgccatcctcagcaacacgccctccctgctggctgcgccatgtcctggatgatgcctccgacgagtacaagatcatcatgctcaaccggcgccacctcagcttccgagtcatcaaggtgaaccgggagtgcgtgcgcggcctgtgggccgggcagcagcaggagctggtgttcctgcgcaaccgcaaccccgagcgtggcagcatccagaacgccaagcaggcgcttcgcaacatgatcaactcctcctgtgaccagccgctgggctaccccatctacgtgtcgcctctcaccacctcgctggctggcagccacccccagctacgggcactgtggggtggccccatcagcctgggtgccattgcccactggctcctgcgcacctgggagaggcttcacaagggctgtggcgccggctgcaatagtggcgggaacgtggatgattcagactgtagtgggggcggtggcctgacctccctcagcaataacccccccgtggcacaccccacacctgagaacacggcaggcaatggtgaccaacccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggcgcctctagactcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttgattggcag

SEQ ID NO: 40785 - DNA, 3430 bp, Homo sapiens
  misc_feature (1)..(1): n is a, c, g, or t
  misc_feature (241)..(241): n is a, c, g, or t
  misc_feature (3422)..(3422): n is a, c, g, or t
  misc_feature (3424)..(3430): n is a, c, g, or t
ngacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacnggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtatccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatgtaccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattatgagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcccctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttcattgacaggtaatgtattttggttgtgcggatggtttgtaaaaagtatcctgtttttttaattctattcaaaattaaaaattttttttcctaaaataaagcaagaaaaataaatgtaagatatataagaaaccccagagtttccagggtgaaagttcacattagcagcttgtccaaaatatttacacctcacaaatattttgaaagaaaccatgttgaaattttctgattttgtgagttacaaccacagcccagtaaaaccaatacttgttatttggctactttcaagcaatgcagatattctttagtatttaaaaatgagcaaataaacaaaatgaggcaaataaatgaagaaaatgagtttctgagacactgtttaggtaaccataaatcagacagatatttttatggtgggcaaattgatgaagatacttttagtaggtgatttatattcataacaaatacatattgaaataattgtcactactgtatcagaattaaaaaccagcttcacattaggacttctccatacaaatgctttatcattggttcttaaattggaaaaatatctataaatgattacatttttaagctaaataaaatgcagatattttggcttcttgtgaatgtaataaagaatcataaaacatanannnnnnn

SEQ ID NO: 40786 - DNA, 2772 bp, Homo sapiens
  misc_feature (1)..(1): n is a, c, g, or t
  misc_feature (241)..(241): n is a, c, g, or t
ngacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacnggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtatccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatgtaccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattatgagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcccctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttca

SEQ ID NO: 40787 - DNA, 2718 bp, Homo sapiens
  misc_feature (1)..(1): n is a, c, g, or t
  misc_feature (241)..(241): n is a, c, g, or t
ngacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacnggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtttataccatgttggacatttgcccctatcagttgctcctcaggaatcttctggtacaggttaacatcagcattttcattttgtatccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatgtaccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattatgagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcccctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttca

SEQ ID NO: 40788 - DNA, 2713 bp, Homo sapiens
  misc_feature (1)..(1): n is a, c, g, or t
  misc_feature (241)..(241): n is a, c, g, or t
ngacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacnggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtatccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatgtaccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattatgagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcccctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttca

SEQ ID NO: 40789 - DNA, 2087 bp, Homo sapiens
ttcaaattcacttattctagtagtttgtagattcctttgaattttttatgtctgtaatcatagaagcattctatgcttgtgcagataaagcatttttcagtgttaaaagttttattgacttctttttctggagtttccatcttctcattttgtcttctccttttggtatcaagtgctaagaatagcaccacttggaaatatgacaggactgcagccagtgtggataattatcattttcaactacagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40790 - DNA, 508 bp, Homo sapiens
gtgctgggattccaggcatgagccacaacggcccagcccatcatttgcgttagcatcatgtgtgtgtacttagtgatcaagttctcttagtaataaatacctgcgcaaaaaggcaagggtaggagagagttctatttagttatatttctcagaatattcagcctcgcttaacatttcttctgggaaatccattggccacatgctgtcttatgagactcttcagatattttccatgccttctctgattgccatcttcccttcccatttgattttcttcagcgggaagagaggcagagcacttgtcctccccttggggagaatcctcaccagaagagctccgctttgggagtctgacctacagtgatccccgtgagcgagaacgcgaccagcatgataaaaataaaaggtaaccaccctcccaggtgagagctgcaatgccaggactccaggcaggactccagtttctccacaatcacaactcttacttttttttttttttggacacaga

SEQ ID NO: 40791 - DNA, 458 bp, Homo sapiens
aatcatgcaccactcggaaatatgaccaggaactgcagccagtgtggataattatcattttcaactacagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcgggtaagtgccagagccgcagcctttgattcttaccccttctcctggattcttgttcctcatctcctgcctggcgcagcagctagattagtaatcaccctgtagcctttcactttcgtaatcagtttgttcaagaaagtcattactttgttcctttcagttggttttacctgctataaattgtgtgtgtatgggtcggggggcagttcttatggtccgtaatctttactccccatt

SEQ ID NO: 40792 - DNA, 642 bp, Homo sapiens
agccgacctcttaggccccgtcgggggagggaagacgaccatcgggggcaatcggggcgagcatggacggagtttcggggctccctacgcgggtaggggagtggggtccgccttgtgacactgaggcagagactgcgcatcgtgagtgctgaggggaggcttcccacaatcagggtacggagcgagggcgtgacggcttcccgaggccctagccgcgtgtggcgacttaaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctacttgtcgcactgtcctgctgtcgccgggctgcctcccaggc

SEQ ID NO: 40793 - DNA, 3871 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40794 - DNA, 3928 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggatgtctcctcgctctgcccggcggcgttggtccatacaagcaattaacgacttcccgaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40795 - DNA, 3896 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaaggtaatttgtcaaactgatgtctcagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40796 - DNA, 4003 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaaggtaatttgtcaaactgatgtctcaggtaaggtgccactctacgcattgcagagttgtggcagataccccagacctgttctctgtttcattttcaaaaatgctttccaacattgaacttctctctcctgctagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40797 - DNA, 2974 bp, Homo sapiens
cggaaagaggaccaacaaagttctccctcttgcccccctcaccccccattccagtccgcacaatctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40798 - DNA, 3197 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggataaggtcttgccaggttgcccaggctggtcttaactccgggcctcaagcgatgcttctgcctcggcctgcagcactaagagttccagttggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40799 - DNA, 2455 bp, Homo sapiens
atgagccgagatcgtaccactacactccagcctgggcaacaaagagagactctgtctcaaaaaaaaaaaaaaaaacctatcagagaaatgtgttcctcttcttgactgtgttttgggccttttctagatcctgaaggacacagccctgcagaaagtgaagcgtggccagagctgcctggagccctgcctgcgccagctcgtctcctgccttgagtcctttgtggtgggaagcatgaaactgtcataccaacttaggctttggtgttttgtttcatttctttctccctaaaatcatgggttttctggttttgtcatactgggtctttattttgtagttcagctttaagacaggttgtggtttttagcttgtggatttttaaatttcagaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40800 - DNA, 1413 bp, Homo sapiens
gtgctgggattccaggcatgagccacaacggcccagcccatcatttgcgttagcatcatgtgtgtgtacttagtgatcaagttctcttagtaataaatacctgcgcaaaaaggcaagggtaggagagagttctatttagttatatttctcagaatattcagcctcgcttaacatttcttctgggaaatccattggccacatgctgtcttatgagactcttcagatattttccatgccttctctgattgccatcttcccttcccatttgattttcttcagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40801 - DNA, 970 bp, Homo sapiens
tgggtcactctagagtatccccgtcctccccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40802 - DNA, 2791 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaaggtaatttgtcaaactgatgtctcaggtaaggtgccactctacgcattgcagagttgtggcagataccccagacctgttctctgtttcattttcaaaaatgctttccaacattgaacttctctctcctgctagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaaggtgggggtctgggttcccaaattctccttgctgttctgcatcattgtctagatggattagtaaagaagaatgaaaactccagtagatgagattcggaagtcatctgtttcgtacacacactagtattagcaacgtaacctctgaacttgccatttactttgtgcagaaaacatcagagcagtggttcttaaccttttttgggtcatagacttcctttgaattctaatgaaaattatggacccttcctcagaaaaatctgcacaatgattgcatatgatttgagaaatattgcctgtaaatatgtgaattgcatagaatctgcccacagatctcattaatactatgcattcatctccggttaggagatttgcaatccaatttcatttagcagcccaggttaggagccctgcagtccaatttcatttacctgaaaacaacaagcaagatgtattctgaagctaaaagatattttataattagaaaaaaacatatgtaaggtcataaaaaaaattttatcccatagaaggagctggtgttatcctagagacaggctggctagctgcacagtaggtgtccaggtggaggcaccacagcctggcatctgtgtttaattctgcagattcagagatttaatgcatcagttcatccagagcaaatcaggtggaatctccatgacaaagccccatgagcctcttcatacccgttcagtctgagcagtgtcacaagtgaagggactgaagtattctgacaaactcaggccaagctgaatgttgctcattttttgtccagtttgggtcgtggacacttgattgttccaccttgttgggggtatcacatggaaccaggaaattttcaagtggcttaaggatctctgaaatgccagtaactcagatcttgtggtatttgacatgttaaacttggaatctgaatatgccgttgcctagtttggaca

SEQ ID NO: 40803 - DNA, 2023 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccagtttattaaccccacaaccatcacatccaccatgaaagctaagctgctgaaggtgggggtctgggttcccaaattctccttgctgttctgcatcattgtctagatggattagtaaagaagaatgaaaactccagtagatgagattcggaagtcatctgtttcgtacacacactagtattagcaacgtaacctctgaacttgccatttactttgtgcagaaaacatcagagcagtggttcttaaccttttttgggtcatagacttcctttgaattctaatgaaaattatggacccttcctcagaaaaatctgcacaatgattgcatatgatttgagaaatattgcctgtaaatatgtgaattgcatagaatctgcccacagatctcattaatactatgcattcatctccggttaggagatttgcaatccaatttcatttagcagcccaggttaggagccctgcagtccaatttcatttacctgaaaacaacaagcaagatgtattctgaagctaaaagatattttataattagaaaaaaacatatgtaaggtcataaaaaaaattttatcccatagaaggagctggtgttatcctagagacaggctggctagctgcacagtaggtgtccaggtggaggcaccacagcctggcatctgtgtttaattctgcagattcagagatttaatgcatcagttcatccagagcaaatcaggtggaatctccatgacaaagccccatgagcctcttcatacccgttcagtctgagcagtgtcacaagtgaagggactgaagtattctgacaaactcaggccaagctgaatgttgctcattttttgtccagtttgggtcgtggacacttgattgttccaccttgttgggggtatcacatggaaccaggaaattttcaagtggcttaaggatctctgaaatgccagtaactcagatcttgtggtatttgacatgttaaacttggaatctgaatatgccgttgcctagtttggaca

SEQ ID NO: 40804 - DNA, 1639 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcataggtgagtaaagggactatataaggctgctgttactcttccaaattctgtcctcttccacaattgtcagcgtagtctctcttgcttggaagagatatgctccagtaagagacggaagatagagatttgctgttggattgtttctgggactgaaagactctgggctcagaagtccagggcatttgccccttgccactctgttgatgagggagacccaaggtggtctttagtactgcctactacataccctcagttgtcttcacaagcatgtagtgctctgtctcaaa

SEQ ID NO: 40805 - DNA, 1985 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggataaggtcttgccaggttgcccaggctggtcttaactccgggcctcaagcgatgcttctgcctcggcctgcagcactaagagttccagttggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaaggtgggggtctgggttcccaaattctccttgctgttctgcatcattgtctagatggattagtaaagaagaatgaaaactccagtagatgagattcggaagtcatctgtttcgtacacacactagtattagcaacgtaacctctgaacttgccatttactttgtgcagaaaacatcagagcagtggttcttaaccttttttgggtcatagacttcctttgaattctaatgaaaattatggacccttcctcagaaaaatctgcacaatgattgcatatgatttgagaaatattgcctgtaaatatgtgaattgcatagaatctgcccacagatctcattaatactatgcattcatctccggttaggagatttgcaatccaatttcatttagcagcccaggttaggagccctgcagtccaatttcatttacctgaaaacaacaagcaagatgtattctgaagctaaaagatattttataattagaaaaaaacatatgtaaggtcataaaaaaaattttatcccatagaaggagctggtgttatcctagagacaggctggctagctgcacagtaggtgtccaggtggaggcaccacagcctggcatctgtgtttaattctgcagattcagagatttaatgcatcagttcatccagagcaaatcaggtggaatctccatgacaaagccccatgagcctcttcatacccgttcagtctgagcagtgtcacaagtgaagggactgaagtattctgacaaactcaggccaagctgaatgttgctcattttttgtccagtttgggtcgtggacacttgattgttccaccttgttgggggtatcacatggaaccaggaaattttcaagtggcttaaggatctctgaaatgccagtaactcagatcttgtggtatttgacatgttaaacttggaatctgaatatgccgttgcctagtttggaca

SEQ ID NO: 40806 - DNA, 2204 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgaggtgagtcagggagatgcagaagccgctctacgttcccggggccagaagtggccagagacctgggaaggaccactgagtttgcttttggacagtgcatttcagttcttcagtaaactcccattataagatttatttgagaaagattgaagtcaattaaattgcaaaaaagctgtg

SEQ ID NO: 40807 - DNA, 783 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccagaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgt

SEQ ID NO: 40808 - DNA, 3606 bp, Homo sapiens
gctctctctctctctctctccccggctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40809 - DNA, 3607 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccagcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40810 - DNA, 2508 bp, Homo sapiens
agaaccatacattacttgtcatttataacaaggatttgagacccctgagactcatgtatcctttagagattcatgctttagtccataaatcacatcagtctgaatacaggagtttgagctcatgagatggtaagtttcttcttgaaagctctagggtctcacccttgagaatggattagagaattgcatgttggtgttcatgtttgccaaagaccacgacgctttcaccctgttaggcaatttgagaaaacattgcctttgcgttcagtttattgcactgacatatggaaaactagggtatactatacaaaataatttaacaccaagtaaaaccacttgaatctccataacttggaggcccagggcctggggagagaaacgctcctgacttcaagttgaagtttgcttaatttatgcattaaggccacccctgggacacgtgttcgtgcttccgtttccttgtcactaacacagggatgataaggtttactctacttatttcgtgtaagactcaaataagatagtgagtgtgtaaaggcaaagcccctctgattccttactcacattctagcataatcttcctgaaaggacaaaggggatatgagtacctaaaggacagaaacactccttgttgttcttacctaatagctcatcttcataactgcacctccagagtcgattgcctgctagcatgctgtggcggtccagtgtcctctgagctccttcatgtagctttaggttatataaatgacatgtgtgggaatcccccaaaagcagtgtgattcttccttggagctgggaagacagagcatgtattggctcgctcagatgtcaggttagtccacttagttcttggagaagccacattcatgtttaagcccatgcctgaaagttagccagaggctttgagatgcgttctctagatcatttgtagtacgtggatgccttatattccaaaacaagtttaggcaaactcaaagtaggtcaaactgccggatctgtagaaagccccatttcctgatgggtttttgaggcagaatcaagactcctcccttcccacccctgtggcagtaacacgccatgactgtgaccgctttcctcctcaatccctcctcctgacttgttttctttcctcttatcttttcctcaggttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaagagagaa

SEQ ID NO: 40811 - DNA, 2659 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaaggtgggggtctgggttcccaaattctccttgctgttctgcatcattgtctagatggattagtaaagaagaatgaaaactccagtagatgagattcggaagtcatctgtttcgtacacacactagtattagcaacgtaacctctgaacttgccatttactttgtgcagaaaacatcagagcagtggttcttaaccttttttgggtcatagacttcctttgaattctaatgaaaattatggacccttcctcagaaaaatctgcacaatgattgcatatgatttgagaaatattgcctgtaaatatgtgaattgcatagaatctgcccacagatctcattaatactatgcattcatctccggttaggagatttgcaatccaatttcatttagcagcccaggttaggagccctgcagtccaatttcatttacctgaaaacaacaagcaagatgtattctgaagctaaaagatattttataattagaaaaaaacatatgtaaggtcataaaaaaaattttatcccatagaaggagctggtgttatcctagagacaggctggctagctgcacagtaggtgtccaggtggaggcaccacagcctggcatctgtgtttaattctgcagattcagagatttaatgcatcagttcatccagagcaaatcaggtggaatctccatgacaaagccccatgagcctcttcatacccgttcagtctgagcagtgtcacaagtgaagggactgaagtattctgacaaactcaggccaagctgaatgttgctcattttttgtccagtttgggtcgtggacacttgattgttccaccttgttgggggtatcacatggaaccaggaaattttcaagtggcttaaggatctctgaaatgccagtaactcagatcttgtggtatttgacatgttaaacttggaatctgaatatgccgttgcctagtttggaca

SEQ ID NO: 40812 - DNA, 3163 bp, Homo sapiens
cttggactacaactcccggcagagctcgcggcagggggtgtgcccgcaatcgcgaggagcgtgggtgactcaaaccaagtgacggaagtgagcgagggcgtgcctgtttgttgcaggcgcggtgtagcaattggaggacccaggaagaaggggcggagcctatgcttgggtcaaccaatggcttgagctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacataggtttgtatggaaatgacttagcccacgctggatttttagttctcccagagctgtgcatatgtaacctttagttgatgcttagtctccatattttttcttatttcttatttctctttacatttactgtgatagggatactcttgctggaggcctgactttgcatgttgaacagaccacgttctgggggtctttgtgccttgctgtgttgcttttcatctcttaaccttgagaaactgacaatgggacttcccactgttcacccccaaaacctaacccttatcctttctccttcacatgctctttccatgttcatctgccacctaccgcttcccatgaatgctttcagtgtagacaaatacagctgggcctgactccagttgatcataaagctgtttgctgagtaaggtgtatttgtgtttcctggat

SEQ ID NO: 40813 - DNA, 5904 bp, Homo sapiens
  misc_feature (1415)..(1415): n is a, c, g, or t
catgccaccacgccccgcctaacttttgttagagatgggatttcaccatgttgttcaggctggtcttgaactcttgacatcaagttattcacccgccttggcctcccaaagtgctgggattacaggcatgagccactgcacctggccaactttataagtaaaaagtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggngccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaggtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttggccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatcctgagaagaaccaagtcaggttttttaaagcagactaaaagcatgaaattgctttcagaagaatgtatatcatcgggaaaagtttgggggcagagtgggggaatcaggctttattcaaaagaaacagttgaaaacatggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaagtagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 40814 - DNA, 4201 bp, Homo sapiens
aggttcctgagtggtttggcactgggcttcttgaaagaacccctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaggtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttggccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatcctgagaagaaccaagtcaggttttttaaagcagactaaaagcatgaaattgctttcagaagaatgtatatcatcgggaaaagtttgggggcagagtgggggaatcaggctttattcaaaagaaacagttgaaaacatggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaagtagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 40815 - DNA, 5177 bp, Homo sapiens
  misc_feature (1415)..(1415): n is a, c, g, or t
catgccaccacgccccgcctaacttttgttagagatgggatttcaccatgttgttcaggctggtcttgaactcttgacatcaagttattcacccgccttggcctcccaaagtgctgggattacaggcatgagccactgcacctggccaactttataagtaaaaagtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggngccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatcctgagaagaaccaagtcaggttttttaaagcagactaaaagcatgaaattgctttcagaagaatgtatatcatcgggaaaagtttgggggcagagtgggggaatcaggctttattcaaaagaaacagttgaaaacatggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaagtagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 40816 - DNA, 6365 bp, Homo sapiens
  misc_feature (1876)..(1876): n is a, c, g, or t
agaaaatgggaatattgccacagcacctggattcatgattgggcagacacctcctccagcacctcctccacctcctcctccaccccctccatctccaccatgttcatgttcaagggaagagtgtccttcctcccctcctccacccccaccacctccacttcctggggagcctcccatcccacctcccccaccaggcctacccccaactactcacatgaacggctacagccaccttggtaagaaaaagcggatgagaagctttttttggaaaactattccggaggagcaagttcgaggcaaaaccaacatctggaccttggcagccaggcaggaacatcactaccaaattgatacaaagaccattgaggagctctttgggcagcaggaagacaccaccaagtcttcccttcctaggagaggaagaactttaaattcatccttcagagaagctcgagaagagattactattttggatgcaaaacggagcatgaacattgggatatttcttaagcaatttaagaagtctcctcggtccattgtagaagatattcatcaaggaaaaagtgagcattatggatcagagaccttgcgagaatttcttaagtttttgccagagtcagaagaggtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggngccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaggtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttggccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatcctgagaagaaccaagtcaggttttttaaagcagactaaaagcatgaaattgctttcagaagaatgtatatcatcgggaaaagtttgggggcagagtgggggaatcaggctttattcaaaagaaacagttgaaaacatggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaagtagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 40817 - DNA, 5816 bp, Homo sapiens
  misc_feature (1415)..(1415): n is a, c, g, or t
catgccaccacgccccgcctaacttttgttagagatgggatttcaccatgttgttcaggctggtcttgaactcttgacatcaagttattcacccgccttggcctcccaaagtgctgggattacaggcatgagccactgcacctggccaactttataagtaaaaagtaaagaagttaaaagcgtttagtggcgacgtgtcgaagctgtctctggcagattcctttctgtatggcttaattcaggtgccaaactattcacttcggattgaagccatggtgctaaagaaggaatttctaccttcttgctcttctctatatacagatataacagttttaagaactgctataaaagaactgatgtcatgtgaagagctacattcaatattacacttggtgctccaggctgggaatatcatgaatgcaggagggtatgccggcaatgcagtaggatttaaactgtcttctttgctcaaattggcagacacaaaagcaaacaaacctgggatgaatctcctgcactttgttgcacaggaagcccaaaagaaagataccattcttctaacttttcagaaaaattgcatcatgttcagaagactgctagattatctctggagaacacggaggcagaactgcacttgctgtttgtcaggacaaaatcactaaaagaaaacatccagcgggatggtgaactttgtcagcagatggaagattttcttcagtttgccatagaaaagctgagggaactggaatgctggaaacaagagctccaggatgaggcctacacccttatagattttttctgtgaagacaaaaaaaccatgaaactggatgaatgctttcagatatttagagatttctgtaccaaattcaacaaagcagttaaggacaaccacgaccgggaggcgcaggagctgaggcagctgcagaggctgaaggagcaggagcagaagcagcgctcctgggcaactggggagctgggggcatttggccggagcagcagtgagaatgatgtggagctgctgaccaagaagggtgcagagggcctgctccctttcctgcaccccaggcccatcagcccctccagcccctcctaccggcccccgaacacccgccgctcccgcctctccctgggtccctctgctgaccgggagctgctgaccttcttggagagctccaccggcagccctgaggagcccaataagttccacagcctgccccggagcagcccccggcaggcccggcccacgatagcctgcctggagcctgcagaagtgaggcaccaggactccagctttgcacacaaacctcaggcctcggggggccaggaggaggcccccaacccaccctcagcacaggcgcaccagcttgcagccgcccagcctgagaaccatgcctctgccttccccagagctcggngccagggcgtcagtgtcctccgaaagaggtacagtgagccggtgagcctgggctcagcacagtcccctcctctctcgccattggctctgggaattaaggagcatgagctggtgacagggctggcccagttcaacctccagggttcccagggcatggaggagacctcccagctgactctgagtgacttcagcccgatggagctagagtctgtggggcataggggcccgcagtccctcagtgccagcagcagcagcctgacacccatgggcagagatgccctggggagtctcagcccagcgctggaggatggcaaggctgcccccgatgagcctggaagtgcagctttgggatctgtgggtagcagcgaccctgagaacaaagatcctagacctctgttctgcatctcggacaccaccgactgctcactgaccctggactgctcagagggaaccgactccagacccagaggcggggacccggaggaaggcggggaaggggatggctccatgtcctctggggttggagaaatgggggacagccaagtctcctccaaccctacatccagcccccctggggaggctcctgcccccgtctctgtggatagtgagcccagctgcaagggcggcctgcccagggacaaacccaccaaaaggaaagatgttgtagcaccaaagagaggctccctgaaagaggcgtctcccggggcctccaagcccgggagcgcccggcggagccagggggcagtggccaagtctgtgcggaccctgaccgcctcagagaacgagagcatgcgcaaggtcatgcccatcaccaagtccagcagaggcgccggctggaggcgaccagagctgtcatcccgggggccctcccagaatccccccagcagcacagatactgtgtggtcacgccagaactccgtgcggagggcctccacaggcgccgaagagcagaggctgccgcgggggagcagcggctccagcagcacccgtccggggagggacgttcccctgcagcccaggggttctttcaagaagcccagtgccaaaccactcaggaacctccccagacagaagcctgaggaaaataagacctgccgcgcccactccgagggccctgagagtcccaaagaagagcccaagaccccgtcagtgcccagcgtcccccacgaactaccccgtgtcccgagctttgcccggaacacagtggcctcctcctctcgaagcatgagaacagatcttcctcccgtggccaaagcccccggcatcactcggacagtgtcgcagcggcagctgagggtgaaaggggaccccgaggatgccgctcccaaggacagcagcactttgaggcgagccagcagtgcccgggcccccaagaagcgcccagagtctgcggagggtcccagtgccaacacggaggcccctctgaaggccagaggggctggggaaagggcctccctccgtcggaaggactccagtcggaccacgctggggagaatcctcaatcccttacggaagtgatgggtgcctgtcctctcctgcctcctgggattcagacggtgaagactgacttctgggacgaggatggggaaagaggcagcatgtctttgttacagataaagcagccactggtgccactgctagtgacgctgttgggatggcacagtccaggaggcctgtggactgcagcctgctgtgctgagccctgctgcagtccagcgtccagatggatgcacgttcactactgtgacggccgcacctcccccatgcaccccaccctcccccaaagcccggatcccgagaaagatttagtaggagtgtaaggtgacattcttatgaaacaagtcaaaaaagtttttttcaggccagtttttatatatcaaagactttctttttaatataaaaattagctaggtgcagtggttcatgcctgtaatccagcactttgggaggctaagatgagtggattgcttgagcctaggagttcgagaccagcctaggcaacatggagaaaccccgtctctatcagaaatacaaaatttggccgagtgtggtggcacatgcctgtggccccagccactctgaacgctgagatgggaaggtcacttgagcccaggaccccaccactgcactccagcctggatgacagagtgagaccttgtctcaaacaaaacaaaacaaaaatgaaatgttctagttttggttccttttgcagagtgaaatgcctcccaggaaaaaaatacatatgtatttttttgcgacagggtcgtgctcttgtctcccagactggactgcagtggcacaatcatagctcactgcagctttgacctcccagacccaagtgatcctcccacctcagcctccctcagagctgggactacaggcgtgcaccaccacgcctggttaattgtttttttttaatttatcttttgtagagatgggatctcactatgttgctcaggctgatctcgagctcctgggctcaagtgatcctcccacctcagcctcccaaagtgctgggattacaggtgtgagccaccacacttggccagtatatcctcagtatgaagatatttttatcttcctgtgttctctggcttcagagtttcacctgcccacacagggtccgttgctggcaactggacttccccataagccttgggtatcctgtgatgggctgtgtctccctgaagattgtctggcttgcccacttctccgtgcatgactctgggtgtgagtctgtctaggaacaggagggaaagttggactcagacagaaatcagatgcttccatgtattcagggcgcgcattgtgagcagtggagtatgagccttgagggcctcatggttgcagggcaggcttccctgcagatgggtggcagcccctggtagaatgctggatttctctggaatctagaagtgccatattttagtggaaaggcatcagggctgtttgacagtgtgcgtctttccaatcccatgttcctccattcgtgtgtctgttataaaactgagtgaaggctgctatgacctgtgttcactctggttacagggaggtgcaaaccattctgtctcccagcctttcttctctctttgtgtgctcccagcacttccttcttttctaacatggcctggagagagtctctctctccttgtctctgtctcttaataatagtttttaacgtggacatctcttccttggtacagtggtttttaaatcctgagaagaaccaagtcaggctttattcaaaagaaacagttgaaaacatggactttttctacccaatgcccatttcacgactcctctgagactaattgggaaacggggaaattcttggaattttttttttaagaaacttttttgtgttttttttaattttaggtcacttattagtgaaacctcattttagatctgacattggtagatagatggatttaggcaaatatgatgcgtttgtggggaatccacgtggttgacgttagaacctcccttctgcagactgttgcctgtcatctaagcgaattggaaatgctgagcttccataagtcagctgagttttaaaggtaaacgttatggctgaagtagtaaagcacctgaccacaaaacctcttgtaaaaacagccctgagtaggtatttccagggctccacaaagttgcttatgggaatcctgagctgcttttcaccatctcaagaagcctaagaagttatatatttaatcaggtagacaaaacagttcaaagcataaggtccatggtggtggaaaatggatgcaagtgattctaagtttgtggatttgtggatagcagagggatcgggacctcttggaggaaccctgggtaccaagctcccaggcccttcctctatcatggatgctgggtgactttgggaagtcaccacctcttcccaagcctgtttcccatatcacagatgtggggccatggcctcgatgatggtctccacaggtctttccacctctgtgagtccaagtcaggtcaatcagcaaggacccatctctgccctgggtcagctcctcagaaccaacccccagcatctctaaagcaaaagcctcacctcaagggctgctcagaagagagcaccttcagcatgagttgttgctggaagatctaataagctgtgtttcctgggaagtggtgctttacttagccctgtggacaacttctctatgcatctgtgtgagcagatgatcattgtattaccttttatcggtagtaagcttggaaaaataatttaagaatacaatggagaaatgtaaataagtatctatgtaaatttgtttaaaataaactgaatgtatttaatggtccatttatatgttcttttatgtaacatgtagtttaataaagttcctgtttatgagagtcatgtttcatctcagcttcttcc

SEQ ID NO: 40818 - DNA, 383 bp, Homo sapiens
gaacaatgagaacacttggacacagaaaggggaacatcacacactggggcctgttgtggggtggggggacgggagagggatagcattaggagacatacctaatgttaaatgacgagctaatgggtgcaggacaccaacatggcacatgtatacatatgtaacaaacctgcacattgtgcacatgtaccctaaaacttaaagtataattaaaaaaaaaagaaataaaatgatgtcttctcaaatatctcggagttaattttagagatcactgtgtgtgttttgtgtgtacataattataggtaatgcttaataaaaaggatgcttaacaatgaacttgctattgtacacagggggatttttagctttcagagcattatgtatgc

SEQ ID NO: 40819 - DNA, 434 bp, Homo sapiens
taacattactacccactcagttatctaatcaatcacccaagccattcttttcactgctgatagaatgattttccaaaaatgaaaaatatgatgattttactcctttgctttcactggcttattaattccatgataaatctgaactacttaacgtggcttacaaaggttgtgtcaaatacttctaggtgttcagcaagatccatgttctcctcttattcctgggtgcacagctgagctactttttctagcctttcttgaaccacatttggccaaatgactgagttctagccaatggatgccatttccagaccagtgcgttttaaaaaacatctgtccctctttcacactctctatttccccttcagctgtgaggatgaagccctaggggatggcaaaatcacaagaaggaattatggcctggagaaaagccattg

SEQ ID NO: 40820 - DNA, 271 bp, Homo sapiens
ctgtctccgccctgcaaagtgttaggattacaggtgtgagccactgcgcccggtcagccactgtcattatttaccagcgttgctctgcctagtgacgtaggagtcacaggttctattttgggtgtgggactgaacagcagggaaacaaagcctaggtgtgtgaaaggaggaaggaggaagctgaaggttctggaatcttgagttctcctttagtctgtctctcaggtcttttctgcccatcctccaggtcactagtattcaaactctcctg

SEQ ID NO: 40821 - DNA, 368 bp, Homo sapiens
atgaaggttgctttctgcttccagggtgacaccttgttgctgtgtcctcacataggtagaagggcaaaaaggggcagatgctgtgtgatgcctcttttactcttttacaaggcattaatcccactcctcaaagcaaagccctcaattctggaaggccttatcttctaatactgttgcattgagaattaagtttcaacatgaattttggaggggacataaacattcaaaccatagtgtacattaattataggtagtaatttcaatgagaatagttaaattaatctttttaaaaaacagatgtagattgttatttaaactagaaactgagattttagcatattaattatgcctgtgatttaaagaagatt

SEQ ID NO: 40822 - DNA, 298 bp, Homo sapiens
tcagtctctggtactacaagatgttcaaggttcatcttctactttcttcaccctatcctagaatcagccatctatgtaaggaactcttggttcctttgattggagagtggtatttataaaccaagatctgagcactggtgtcattttccctcctcctgaagcacttcctttagcatgtcttgcagtacagttctgctggtgatcaattctatcagctgttgtatatctagtggttcttaccttttcttctcacagttttcttacatgcatgagctgatcaatattgtgttgaagacta

SEQ ID NO: 40823 - DNA, 307 bp, Homo sapiens
aagttcattttgtctgatactagtagagccatcctggctctcttttgattactattttcatggaatatatttttctattctttcactttcaacctatttgtgtctttgaatctaaagtaagtttcttgtaggcagcatataattggatcatgtatttttatgcattctactaatccatatatttttactatagagtttaatcaatttacatttaaagtaattacagataggaacagatttacttctatctttttgctacttacttcctatatgcctcataactgtttttgtccctcattttctgcat

SEQ ID NO: 40824 - DNA, 894 bp, Homo sapiens
  misc_feature (3)..(4): n is a, c, g, or t
gtnnaggttcagttgtttatagggctagctttgcttactgtgctcagtttctgctgtagtaaaataatgtaggctggctggaggtggtctctgttcagggttattatgaactggccttgttcttccagtgtgcaggccctggctaatcagagaagtgtacctgtcccatagctaggctctggaaagaccttcaagcatggcatgtgaactgggccctggctcctccccaccaggtccatttggagtcagtggtttctaaatggtggcagtgagtgctttgctctggccctcagccttcttagctttctttaccactgtagagccaggtagctaaaataatctgccctgtttttcttccttatgaggacattttctggaatttttatcccaccttatccattcttctgaaaaacttgtcttcagacctcatttttctaactcccagataaccagaacctacatgcagaggtctaggagatctctaccctgcaagcagaggttcagaaaaggagcagagtgagcaaatgcagataccattgttctgttcccctgtctaacaccccctgtaactcccagttgccaaattcagactcctttctttggtctgtaaagcccagcctgatgggttcctgcgccctctccagcttcttcctgtgcctcacacactgaatgcctcgagtactcacatttccagggacttgataacctctggacttttgacggtgcagtttccttgccaatgctccgcaagaatttcttcccaatttaatcagtgtaattaaccaaaaaaacctcgatgaaggtagagcactaagaaggaagtaggtaactgttaaaagattttatgtctggaaaaaatgcccccttttttttgtatttgcaatattccattac

SEQ ID NO: 40825 - DNA, 678 bp, Homo sapiens
ttcctatgctaaggtacaggaatatggcacaggggccagtgagtcttggaggagccatctctcccgcaaaatgatcttttggatgctaaaaaaaagaaattctcctgggggtcacatggaattaaaagcatctacccagaaagcagactcaaaagcaatctttaagcacaaaatgaaagggctctatacttaccatgtcttgttactaaataatcattccagaactttcttgaattgcatccctttttgggggaagatcatattctagatttagattccataatgcagagtgtagaaatagaaaagggcagttttattttattttattttttctaacagctacactggtggggattctttgccatttatccttccaataggagtaaggagaacacagggagttcttcagtggggctgcccagaaggaaggttttctgagtgaagagccagtgccctcacacgtggagtcgtgtgatggatgactctgagctgagccacaggaaagcaagcagatccccttagccttctgttctctccacaagcaagcagaagcaagggaggcacaggtatccatcaggaagggaaggcatgatcctttacctggtgagttgcagatgctcactcttgaccataagaggaagaagacaaagacagaaaagccagacaccagggattact

SEQ ID NO: 40826 - DNA, 409 bp, Homo sapiens
cctaagccactgtccctggcccacatttctctttataataaaactcccaagcttccctttttcagacataccaaagcccacctcagtctgtgtgtatgccccaaattgctattctgtgattcccaaataaaacatttaatttagagatttgtttctatgttttcttttgattgcaacaggagcgtatggggaaaggcaggataggacagcctgcagaggccatcccaggccccaaagccaccccatttctctgcattacagttggtgtcagcagagcccaagccagggattaggggacactatggctcagaggttcaagctaagcatgggttaaacagtcttgtgaactatcctcagaccctcaccaccatcttcaattttacatctatgaaaaaactttaaaaaaaaa

SEQ ID NO: 40827 - DNA, 408 bp, Homo sapiens
ttttttttttgaaaacggagtttttgctcttcttgcccaagcttgagtgcaatggtgcgatctcgactaacttcaacctccccctcctgagttcaagcgattctcctgcctcagcctcccaagtagctgggattacaggcatgcgccactatgcctggctaatttgttgtatttttagtaggaatggggtttcaccatgttagccaggctggtctcgaactcctgacctcaggtcatccacctgccttggcctccccaagtgctgggattacaggcatgagccaccacacccaactaaaaaaatcttagaagaaaacctaggagaaaaacattggcctaaacattctggacattagcctaggcaaagaatttatgatgaagacctgaaagcaaatggaacaaaatttt

SEQ ID NO: 40828 - DNA, 502 bp, Homo sapiens
gccacttggatttattttcttagtctttggacatgtgtttaaaggaaaagaatacctgtaacttcctatatgacatccagtgccctgaaagggtgcttacaccttcaaaaaaggagagtccagcctatcaaaggcagtaacacataatgagaagaaactcagagttattgcctttcatactgctttccctctgctgttggcccacccttcttgactgcaaagccagaaaataaactagatggtggttttggacaattgtacacaggaacagaatctctaataacctataatttttagtacttaattatgtgatgttttattctaggaaataagaaacagatgacatcattgatgtatctttctttcatcttcagaatttttgcatcttttcagaaaatgacaaattactatttttctgttgcactcagcaattgtgactatacttaacaaaattcttgtagtctgtagagatatcaataaaattgtatatgtttgtacatag

SEQ ID NO: 40829 - DNA, 591 bp, Homo sapiens
tacttgtgtcactgcacacttgagccttatttcataggatgtattttgctaataagtgtaaaatgactctgttattaatttttttgattcctaataatgtgagcatttgtccttgaatatgagtatatgaggaagagccaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtgga

SEQ ID NO: 40830 - DNA, 424 bp, Homo sapiens
tgatcctacagtagccggttatctagaccagtaagtggagttttggacatgctgctgctgtcaactcactggctgaaggagcacttcaaggaatgggaggcctttcactgggtccagctctgattcgggtcaccagtgaaaagttgtgcagagcccaacatgagcttcatttccaagctgccacctatctctgcctcctgcgtagcatccggaaacatgtggccctacatcaggaatttcatggcaagggtgagcgctcggtggaggagtctgctggcttggtgggtctcaagttgccccatcagcctggagggaagggctgggagccatgaacatggagaatatccttggatgctgcattcataggagaattgaataatttctatcaatatgtatttatcattaaattttttttaagtttaaa

SEQ ID NO: 40831 - DNA, 475 bp, Homo sapiens
cctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggag

SEQ ID NO: 40832 - DNA, 361 bp, Homo sapiens
gctcgactctatgtgttttgggagatgaggggtggcgagtgagagaaagatacttagatactatatgagataagaccaaggtgggttgggctgggggatccaggagaaagcagctccccagctgccccctatccacctactggggcacagccctgcagaataaacctggcagcctgaagttgagctttcttgagtcattctgtaccatctttcaagaggttttgccaagaaaaatttggaacttggaaaaattttggtacaaccaacgtgtgccacccatcagctgacagaggtaagttggtcccagccccaggagtagggcaatgcctatttattctactgaatggtttgtttgagtgaa

SEQ ID NO: 40833 - DNA, 687 bp, Homo sapiens
ttaaagttgtatttcttgttgtggaaccaaaagtatcttctggaggagacaggagattattaaagggtgtacttaggtgacctgagggcaaacctggtcagtcattttatcgagaaataggtgggatgcttgaacagcctcaagtaaagctgagtcttactccctattcttctgacactggccttcttatagagttgttaatattgtcctccacccctggggatgggactgcctgcccactttgtagaccagcagatcctaacttttccaatgagaacttaggaaacaaataaaattgtacgcccctgcatcagaatttttctgttttattctctgattaagaaagtacacatgataaaaagctacctgaattcatccaatagcagctttaagtgactatctaaaacttgatattcagggctgagcatggtggctcacacctgtaatcccagcactttggcaggctgaggcggtcggatcacaaggtcaggagtttgagaccggtctagccaatatggtgaaaccccagctctactaaaaatacaaaaattagctgggcatggcggcgcacacctgtagtcccagctgctccagaggctgaggcaggagaatcgcttgaacccacgagggggaggttgcagtgagctgagatcatgccactgcactccaacctgggtgacagatctc

SEQ ID NO: 40834 - DNA, 342 bp, Homo sapiens
gctcaataaactaatgatcattgctgtttctgctgtggagccagtgctcaaggacaaagctaactcctggccaccacaccgagctgtgccccacactccatgccccactgccacaccaggagccacctggagcctccaagggaaggttcttgaaatggcgggcagagggacccccactcctgccccggcaatgaaccctactctcagagacatgagtggctatgttcagctgcctctggggggacctaagctgttctcatccaggttctctcttttctagaaacctcctgggtgcctgtgaggtcccctcagaccagggagtggagcatgtaccatttctgc

SEQ ID NO: 40835 - DNA, 322 bp, Homo sapiens
aaaaaaatccaaccaaaaatttcatacctttccaatctaaacttcatgagtgaaggagaaataaaatattttccagacaagcaatcactaaaggaattcattaccagtagactaggcttacaagagatcctcaagagagcaataaatatggaaacaaaacaacaatcccttaccccaaaccacatttaaatatatagtccgcagaccctatcaagtaactacgtaatagaaactacaaagcaaccagctaacaacttcacgatagtatcaaaacttcacctatcaatataaaccttaagtgttaatcgtctaaacgcaccac

SEQ ID NO: 40836 - DNA, 360 bp, Homo sapiens
tttgaacgcacacacacacacacacaaatacacatgcacacacacgtgcgcatacacacaccaagatggctatacccctcactgccagtttctttcacagagctgtggtgaaaagctcggacagagatggaggcaaacagctctcagccatgcggggcttggggttggtgcttttctctccatccctgggaaaacagcacaggatcttccctgcaggaggccgggggtctcctgcaaccgacaggcaaccgatcagcacatcaaagtaaaagctgccctgggctctactccaggaagctcagaaactcaagcgccctcagaattaagtgatgaagaggagcgacccaagctgcctgggtc

SEQ ID NO: 40837 - DNA, 1140 bp, Homo sapiens
gattgaggaaaagcacaatgaggatttattctcactaaaccagattgaaaaaatgaaacccaaggaagaaaccattatttgtacttatgcccctggttccaggtttacatccatgagtatttagcaccaatctttccatctttaaactgtagttggctgggattcctgatacttcagtcagaagaagcagaattagtatgactatttacctagaaaaagcatcgagtgggtctcaaactttaaatacgtcaaaataaacctggtttgcaggcctcaactcattaccctgggcacttttaccacagtggagcatctggctctcaactttacaggtacagaaaccaagctttgtgaacacttagaaaacaggatcactccagattgaaattcatactactctagctcatgaagctgatgaaagaaatatactttatttatttatttatttttaaattattactattttttgagatggagtcttgctggagtgtagtggtgcgatctcagctcactgcaatgtccacctcccgggttcaagcaattcccctgcctcagcctcttgagtagctgggattacaggcatgtgctaccatgcctggctaattttttgtattttagtagagacggggtttcaccatgttggccaggatggtcttgatctcctgacctcgtgattcacccacctcagcctcccaaagtgctgggattacaggcgtgagccactgcacccggcctatacttgatttataagtacatcacaagtaatgcaacaacctacacacttgcaactacaaactttcagattatttccgtggctgactaacctccacattatcagagccacattcttttatggaaatatttaggtttgtgcaaaagtaattgcggtctttgccattaaagtaaaggcaaaaaccacaattacttttgcaccaatctttatatttatataattcactagcttgcagtaaaatcccacaagctgattaccaattttctctctttcaggagtcctctctaacctctaccctgatctttgtttgtggatgttgctcttgagctcctgagtacactcttacttcccccatttctaggatcttgggcaatggggaagaccttgattgtaactaacatatatga

SEQ ID NO: 40838 - DNA, 752 bp, Homo sapiens
aaggaagctcttctgttgtctcgttgagagtaagaggctgggtggactcgggcaagactctgaacacatctttgtcaattttaatatggagagtatgatagtgagtgacctccaagggtgagtatgaacattcaatgtgttaatacacacaaaacccttgaaagaatgccagacacataataagtgttgtaaggtgttgactactatgattaccagagatgtctgtggatttgagaaaaggaagggaagtaggaataggagaggcaacaaaattgaggactgaagagaagggtcagattctgagagggcctttaagccaacatggagccagaagcttgtttggggaaagtaggcagaaattaaggaacatactccaccccaccccggggcacccaaacctggtgcagccctgatgtttagtttccatgtatccctggcctcctgtgctcccctgctggttggagacttaatagctgctcagacattttttgctgttcactccttggtgattggaggtgaaaagaatgcaaaagggtgtaaatcaaacaggaagcccctttttagtctcctgctggatcccagtcaaatgaggagggcatcatcaatggtagactgaataaagaaaatgcagtccatatacatcatggaatattatgcagccataaaaaagagtgtgaccatgtcctttgcaggaacatggatggagctgaaagccattatccttagcgaactaacacagaaacagaaaccca

SEQ ID NO: 40839 - DNA, 940 bp, Homo sapiens
agcgttcagaggtcaccgttatgtcggaccaccgcaagagatcctgttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttgggccacagagatcatatgacatcctaggaacgtaatgttcaaggaatggatctgatcttggggatttcccaggaagcccatcactattcagagaaactactagggtagatgctgtttccagccttagcaagactgaattggtaaaaaagcatgtcctagcaagacttctga

SEQ ID NO: 40840 - DNA, 742 bp, Homo sapiens
aaagatctcaaaacactgaagcagaccgtaccaaattgactttattgttttaaaaccagccccttctgtctgccaccacccgccaccccttcccgaaggaaggaaaaaaatcataatagatgtctctccagcgtgcacctctgttctcctctctctaatggcagcttgggaccctgaggcagtgacgcttagtaatgtatcctaatagtcagtgtttgtctgacaaataccctagtgaccacaagcctaatcagggccgccatgaattaatggtcagtgtagtgatgggtgctgaatgatcataaaaatagcttgggaccctgaggcagtgacgcttagtaatgtatcctaatagtcagtgtttgtctgacaaatacctagtgaccacaagcctaatcagggccgccatgaattaatggtcagtgtagtgatgggtgctgaatgatcataaaaatagctaatactgggccgggcttggtggctgatacctgtaactttgggaaacggaggcaggaggactccttgagactagaagttcgagaccagcctgagcaacatggcaaaaccccgtctctgaaaaaaaaaaagaaaaagggggccatgtgtggtggcgtgcacctgtggtcttagctacttgggaggctgaggtgggagaatcacttgagcctgggcagtcgaggctgcagtgagctgtgattgtgccactgcactccagcctgggtgacagagtaagaccctattt

SEQ ID NO: 40841 - DNA, 595 bp, Homo sapiens
aaagatctcaaaacactgaagcagaccgtaccaaattgactttattgttttaaaaccagccccttctgtctgccaccacccgccaccccttcccgaaggaaggaaaaaaatcataatagatgtctctccagcgtgcacctctgttctcctctctctaatggcagcttgggaccctgaggcagtgacgcttagtaatgtatcctaatagtcagtgtttgtctgacaaatacctagtgaccacaagcctaatcagggccgccatgaattaatggtcagtgtagtgatgggtgctgaatgatcataaaaatagctaatactgggccgggcttggtggctgatacctgtaactttgggaaacggaggcaggaggactccttgagactagaagttcgagaccagcctgagcaacatggcaaaaccccgtctctgaaaaaaaaaaagaaaaagggggccatgtgtggtggcgtgcacctgtggtcttagctacttgggaggctgaggtgggagaatcacttgagcctgggcagtcgaggctgcagtgagctgtgattgtgccactgcactccagcctgggtgacagagtaagaccctattt

SEQ ID NO: 40842 - DNA, 420 bp, Homo sapiens
aaatgtgtgatgtcacttccaggagatgattcccatggtaaccatctcagtggaattggggggtggccaggaaatgggggctgagggcggatacagaagggacaaatgtgaagagcggaaggaaagggggagggggagaaatgcaggaaaaaaccaggaagaggaaggggaccttcccagagcagttgaaaataatatacagaatctcagaaatggaaaggtccccagagaccactaaatgcaacaacctcatttttacagaggctgctgagaggccaggacttgctcaaggtcacaccgccagttgacaggttagagccaagcccaaggctgcatgactgtcaggtttgggtggggtaataaaggattcctttcagccatttctctttgttttgttttgtttttttccccgagacagag

SEQ ID NO: 40843 - DNA, 581 bp, Homo sapiens
gcctctactaaaaatacaaaaaattagccaggcatggaggcacatgcctataatcccagctactcgggaggctgaggtaggagaatcgcttgaacccgggagctggaggttgcagtgagccaagatcgcaccattgcactccagcctgggcaacaagagcgaaactccatctcaaaaaaaaaaaaaagagattataaaagggatgatgaacatggagctgcatctttttaaacgttgttttttgatgcttcagactcttaatgcttttatataaagctatcaactgtatgttgatcacggtttataagaaagaacaaataaaccaagattggcaatccttgccgatcttttagaaataccttttctggagaaaaaaaaatccacatgaagtgcaataagcttataaagctaagtagttattaatatttctattaacatgatacaaaggatgatgattgtaagtgtttactgactggcagcttttatttcagtattagcacagcgtcttgccagtgttggaggccatgtattatttcagttcaactggatgaaatgttaaataaactcagaatgaaaataaa

SEQ ID NO: 40844 - DNA, 334 bp, Homo sapiens
tctgcccttgtttctctgtatacatgaggttgggtgactgtcctagatatttacatgcctatttcaggcagctcttaactagcatccctgaagttcaatcccaaactctcaagagaggaagaagctgatcggctcatgtgctcagctttgagcacatgtccctccttggtccagtcagcactggccaggggcaagatcccagcacaaatatgggtgccatggatagcgttgtggataggggtctgataatacttgtcaaggaagaaaattgtgggctggagttctctaaaattgaccactacctaaaattgaccactaccctatgatatcttag

SEQ ID NO: 40845 - DNA, 1178 bp, Homo sapiens
tcacaaatctctgggatcataaggaacctaatggaaccttcctcaacagctgagcctcagtttccctttctggaaaacctccccctatacttccatacctcatcgttccagagatgatttacaataatggcaagtaagagaaactctgtagagttaaaggactgcagaaatacatgggcatttatgagatgacatgcactcgtttgttgcagaccacctacgatgcttgctggtcacctacaagagtaatcccagctagcgctgaccccatgtgagaatcttcagataacttacttagtcctcaccacaaccctgtcacataactgggatcatccccattttacacatcagagaaattaggggaaagcctggaggactcactaatacattgcagcttcggggcggagctgtgagtcccttgccgcatgtattggactccaagggggccactcagagcctgttgctgagacacttctgttctcgcgggtgtacagcaagtactcagtgactgtgtggtggggggagctggggcccgggcattaatagatgatccacagagctgtcattctaagtctcagtgcagagccataggggttcccagcagagaatggtcactgaggtcagggtgcctccaccacaggaggggccttgacagatgtagaccacttctgactgggacccactaacttctcactgggagcagagttaatcaagtcacagagatgggtaagaaggcaaggggccacttctcatgtggtgagcggtacaggtgagcagagcacagggctccagcagccggatagggaagggggccccagcccaccctacagctctactccctccatcctgctgcagaccccccattcacacagtgagtcagtaacaggaaggagcccttggactgcggcaatgccattagcgaccccatgggggaaaggggaagtggggagggaaaggaagaggcgaggcatcctagctccctcaggccggaaggctgcaacagctgcagccagcctcccactctgccctcaccccgtcccggccccaccactccactcactcagaggtcggtggccaggagcctggccaatcagaagcaccaagggcatcttgagacctctccccagatctactgaataagaatgtctaagatttctagccattacaactacaaaaaa

SEQ ID NO: 40846 - DNA, 447 bp, Homo sapiens
attcggcacagcaagatagtaagtcaaggagcatctgtactccatttattgacaccccatttaaaaaaattgttaaaaactatcaaactatgaacatgaagtgaaggatgcatgtttcgatgtagtctgaaattagctttcaacatgaatgaagtgttaggttttagcttcgtgggcaactttgtctgattttcttccattgacataaaaatagtctcaggcttgtgtgggaaaattaagtatatagatactattgcatttatcaagggagatataacttgtggattcattctataatgttttacaggagaattttttttatctcagaaataaggaattttacatctctacaagtaaatcagaaatataattagatacataaattcataaacatacaaaataggtaaaatgattatatggatttctaaaagtacctttaaattggct

SEQ ID NO: 40847 - DNA, 637 bp, Homo sapiens
gcaatggcgcaatcttggctcactgcaacctccgcctcttaggttcaagcaattctcctgcctcagcctcccaagtagctggaattacaggcatgcactaccatgcctagctaatttttatatttttagtagagacagggtttcaccatgttggccaggctggtctggaacccccgacctcaggtgatccacctgcctcggcttcccaaagtgctgggattacaggcatgagccaccatgcccaactggattctggtatatatttcaaaggcagagctgacagggatttctgtcagactaacgtgaagcatgaaggaaagggagtagtttagatctttggtctgaagagcctgaaaaattttccatttactgacataggaaatctgagggaagaaaatgtttggagaggtgagggaatcagtttagtttggggaaggttaaatttaagaagacttttagttatccagttagatagttgaataggcagctagtacatgaacctggcattaggggtttggggctggcatacttaaacatgtggctagatgtgatcaccttcagagtaaatgtaaatagtatcatccctccttatctgtatctgcagatttgatcgactgtggatcaaaaatatttggga

SEQ ID NO: 40848 - DNA, 441 bp, Homo sapiens
gcaggggaaggtagtatactgccttgctactgccagatgggggcagtagtccagattccccactcagacccatcattcctgctgggcaggggtgggtgtcccagctctccactagtcctcaactgatacgtgcctggtggggattggtgagtgcctgttactgttctgttgatgccatgggagatggaggggtcctctgacaccattccagcaggggatgggggaatgtctcattaccactaggttggggtggacgtcatggttccccatgtggtatctccacaaacagcacaggaggtggtgggggacacttgttaccacccatgggaatgaaagtctcggcttggtattcgaccttctctgacgccaccctggcaagggggtggggcacctcatgacagcttggagagggtggagtctagactctctatttggcctttg

SEQ ID NO: 40849 - DNA, 759 bp, Homo sapiens
caatgaatatcccacaaatgaaattaagaaaaaaactcccatttataatgtcatcaaattaatgaaatacttaggaatatatttaacaaaagaagtgcaagacttgtacactgagaactatgaaacattgctgaaagaaattaaagaagatttaaagaaagacatccccctgttcatagatcagaagatttaatattgttaggtagcagtactctccaaattgatctacatattcagcagattcactaccaaaatgccaactgccttttttgcagaaattgacatcctaatcctaaaattaggtaaaaggcacctaatagccaaaacaatcttgaaaaagaacaaggttgggagacccatactcccaatttcaaggcctactacaaatctacaaatcttcggtaatcaagacaatgtagtactggcataaggatacacatatagatcaatggaatagaatcaatagtgcaaaaacaaatgtttacttttatggtcagttgattgtcaacaagggtagcaagatcattcaatggggaaagagtagtcttttcaaacaaactgtgcttggacaactggacatccacacataaaagaatgcaactggacccctacctcacaccatacacaaaaattaactcaaaatggatcatcctcaatgtaagaactaaggtataatattcaaaggcaaaaaacaggagtaagtcttcatcatcttgagttagacaatggtgtttcggatacatgccaagagcacaagtg

SEQ ID NO: 40850 - DNA, 367 bp, Homo sapiens
cagctgtactgatgccacagggcattggcatggatggccctgggtttctagagtccatggcttgttttgatccaagggcatataccacctcacctctgctaagaaccctaaagactcctttcccatgtctctggccaagaatgagggaggtagggactgcccccctcaccaaggaggtatctgaaccttggtgaggtagcttggacacttggaggtagctcagagtgtcctctagaaagccaggaggaggccaggcatggtgtctcatgcctgtaatcccagtactttgggaggctgaggcgggcggatcacctgaggttgggagtttgaggccagcctgaccaacatggagaaacccagtctctac

SEQ ID NO: 40851 - DNA, 249 bp, Homo sapiens
tcacagacctactccttggccatatgactaataaaagtctgaaagaaagactttattagaaccttcgaaggccatttgttttcacagcagaaaaacatggtgtttgaatttactctcctaccagtactgtccccagtggcacagggtgaattttctaaaatgaaatctagttgctgtcagaaagggaaaagtaaaaaaacaaaaaactaaaagcacacatatgcacaatcttgtgttagaactggacac

SEQ ID NO: 40852 - DNA, 2347 bp, Homo sapiens
tgtatcggttcattaaacataaatattgagtgtccactctatgctaacaactttgatgggtaccagaactattaaaatgagattacaggtatgagccaccacgcccggcctgtgctttggttctttacatgaaactccctttctaccttgtgttgcctggcaaaatcttacttacccagaactctgctccggcatcctccgcaggaagaacactttcattgaaccctagcattgtccctaatacccttaatatgtattgtcatagcaccctatgaatttttctatatcactttccatcttatatttaaataatctttttacttgcccatctctcccactgataatctaagctggcagaggctggatcagatcataattatctttctattcttagcgctaggatcaatgcctggcatagcatatttacattttttatttaaataaactgacctgactttcttctggttggatatgttctgagtccctattactaaccttggtcttttatctcagaagttgaaggctcccctggagccagctgcaaagttcccaaagccctaacaaccccacagccaatcagctacagagtaggctgccctgagtcggactccccaacacaaagtccagggttggagcaggagcacggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagctgcaataatttattttaactcaagatttcaatttcatggtgcagaccataaattcaatcagtgtgagctgcaacaattacaaggtatctctttatccctggacgtcacctcagatagaactttttctttcaaacttccccaactgcagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaggctggcatctctttgca

SEQ ID NO: 40853 - DNA, 1760 bp, Homo sapiens
tgtatcggttcattaaacataaatattgagtgtccactctatgctaacaactttgatgggtaccagaactattaaaatgagattacaggtatgagccaccacgcccggcctgtgctttggttctttacatgaaactccctttctaccttgtgttgcctggcaaaatcttacttacccagaactctgctccggcatcctccgcaggaagaacactttcattgaaccctagcattgtccctaatacccttaatatgtattgtcatagcaccctatgaatttttctatatcactttccatcttatatttaaataatctttttacttgcccatctctcccactgataatctaagctggcagaggctggatcagatcataattatctttctattcttagcgctaggatcaatgcctggcatagcatatttacattttttatttaaataaactgacctgactttcttctggttggatatgttctgagtccctattactaaccttggtcttttatctcagaagttgaaggctcccctggagccagctgcaaagttcccaaagccctaacaaccccacagccaatcagctacagagtaggctgccctgagtcggactccccaacacaaagtccagggttggagcaggagcacggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgtaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaggctggcatctctttgca

SEQ ID NO: 40854 - DNA, 279 bp, Homo sapiens
gtcttttaagacttcaccttggaagtcacactccatcatttctgcaacattgtcttggttactcagttctgccccattcagggtgggaaggaaggatctacacagttgcatgaaaacgagatggtaagacttaactgagagccatcttggaagctagttccatttgtgttaccagtggccagctctcatttaagtttcaatctacctattcactccttcccaggtactaatgcattctttctcgctttcactctactgtaacacatttcgacttgccag

SEQ ID NO: 40855 - DNA, 2198 bp, Homo sapiens
tgtatcggttcattaaacataaatattgagtgtccactctatgctaacaactttgatgggtaccagaactattaaaatgagattacaggtatgagccaccacgcccggcctgtgctttggttctttacatgaaactccctttctaccttgtgttgcctggcaaaatcttacttacccagaactctgctccggcatcctccgcaggaagaacactttcattgaaccctagcattgtccctaatacccttaatatgtattgtcatagcaccctatgaatttttctatatcactttccatcttatatttaaataatctttttacttgcccatctctcccactgataatctaagctggcagaggctggatcagatcataattatctttctattcttagcgctaggatcaatgcctggcatagcatatttacattttttatttaaataaactgacctgactttcttctggttggatatgttctgagtccctattactaaccttggtcttttatctcagaagttgaaggctcccctggagccagctgcaaagttcccaaagccctaacaaccccacagccaatcagctacagagtaggctgccctgagtcggactccccaacacaaagtccagggttggagcaggagcacggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaggctggcatctctttgca

SEQ ID NO: 40856 - DNA, 1363 bp, Homo sapiens
accagacctaggaattcctagaaaaatagtcaggaagcatttagacacatcaaatgttaaacgagtcctgattatgatgataatgatgatgattttggtggttgcaatagcaaagccttaagtatgaaggagacttgccagctggaaatacaggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacacacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgactcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttataggagaaggctggcatctctttgca

SEQ ID NO: 40857 - DNA, 1455 bp, Homo sapiens
tgtatcggttcattaaacataaatattgagtgtccactctatgctaacaactttgatgggtaccagaactattaaaatgagattacaggtatgagccaccacgcccggcctgtgctttggttctttacatgaaactccctttctaccttgtgttgcctggcaaaatcttacttacccagaactctgctccggcatcctccgcaggaagaacactttcattgaaccctagcattgtccctaatacccttaatatgtattgtcatagcaccctatgaatttttctatatcactttccatcttatatttaaataatctttttacttgcccatctctcccactgataatctaagctggcagaggctggatcagatcataattatctttctattcttagcgctaggatcaatgcctggcatagcatatttacattttttatttaaataaactgacctgactttcttctggttggatatgttctgagtccctattactaaccttggtcttttatctcagaagttgaaggctcccctggagccagctgcaaagttcccaaagccctaacaaccccacagccaatcagctacagagtaggctgccctgagtcggactccccaacacaaagtccagggttggagcaggagcacggagagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggtaagttgggtgggtagcttgagctttctcccagattttcactgggttgtggactcataaacttgtgagactggaaaggactctatgtcttttacactaatgatggtaccaaattcagggacattgttgacaaggatgatgactcaattcaagcttcccaaacaggtactgtaatgaaatggaaagaggacaggactgaaagccagggaatggaatttgtggtactgctttgtcgctcaacagccacatgactttgggcagtcacttaacattttttatctccaattctttcctttataaaataaaagagttagactgtattatctctaaggtcactttgagctccaaaatttttatattaaatattttgaggagttcatttatgttcttcaaacatttattaaatacttcctgtatgccctatgcaagataccgataataaaaacatattaaatatattctccagt

SEQ ID NO: 40858 - DNA, 488 bp, Homo sapiens
acaggcccatggtcaaccagctaagaagtgaaggggcaggacttgaattcaggcctcctggccccagagtttgcagcacctggcatgtggcagtagttgagaagttacactgagtctgagtagacctgtagttagtgaccccctccacagcacagggctgatggacagtgggctggcttgggccaagagcagctggcactgcagatctgttggaatagctctgcccaggctgcccagggcaagttgcagactgggaggcatatgtatcctaaaatagaacttttgagaaataatgtgcatccaaaggaatgagtctcagacgaggatgttcaagaatcagtagcagatgctgtgcgggccacagaatgtttctaggtaaaatgccctcctccccaccccccatgtcccccacaaccaacaaacaagctaagaaaaaagaaacaaaataaaataaattgaaacaaattaataaacatgcaaaaaccaca

SEQ ID NO: 40859 - DNA, 555 bp, Homo sapiens
gaaacttatcaaattaaactttttggtggacttgacatcctaatttttcttataacccctcccccagtttactcattattaatattttatttacaaggtacataactttgtaagcagatttgttgaatatttgtttatctttatggatactgtgttacttttaatgaggtagaattaatagttgtactctcatttgtcctgtatacagtatggtacattgggtccttacatatcaatatgggtggtacttttatgcccattttattgtcatcttaaagagctacattgtaatgttatgcaatgcctcctggattttacttctgtctcaatctcttttctcctactaaactatacttctctcctgttttctgttatatcctctcttcaaatactcttatgttatcttccagttgttcagagcttcctgttactgcttcagtgagcctcttgcagtccctcatagattcctgcagtcttcctgtgttctagctggtatgtctttgtctttggaaattctctaaaatacaaatctcatttctctttaaatttcttaga

SEQ ID NO: 40860 - DNA, 529 bp, Homo sapiens
ttaatttggcaacaaatttttaatttgtatcaatctaatgtctgtctttcacatacttccaaacattacataaattattttacctagtgcatacaactttcaaaaactgtatttggcaattaacagacccctgacaattattaacaggggttttacatcccggagtttgagtgtctgcgggagaaccgtccctgcaggaggcactccccctccacctgcgacccgggctgggagaacgcgcggagggctcccttgagcggtctccgccagcgaggctttcctcccggtcggtgttgacagtgtggcatttctgttatctaatttctggttttgactgaaagcgaagtgagttttctcatcagtggagttgtaatatttctgcaaaaaaaaaaagatcacagccctccgatgagccgggcactatgcgaagtctccggctgcctgcgggccgctgtggacgccccggcgggggtcaggaccgacccccatctgcgcggcgaacgagcccggacgccctggccgcggccgc

SEQ ID NO: 40861 - DNA, 453 bp, Homo sapiens
gctcgactgctgatcaaaattgtgagaagttgtctggaagtaagcaactaaagctaagatgaactctgctgagacctacttgctacaaaacatttgcccttataaaaatcgagggctgcacaaaagaagagccttttttgtgtgtcactgcttctgcctttctgttttagaggctcttgttttaggatgccagcactggtagtctttgcaatcaaaggacgcacaaagaaggcttcttagtgtctagaccttgttgacaactgaagtcagctctacaggcttcctcgatttatttttacacatcacaagtaaatgcctttgctgtgcaagctgtcagtgtgcataagtgttcatttctgtgtgtgtttgtgtgtgtgtgagagggagagagacagagagagagtgagtttctagcttgcatcctaataaactatctgatgtagatgaggttgt

SEQ ID NO: 40862 - DNA, 532 bp, Homo sapiens
taatcttagcactttgggaggccgaggtgggaggatcatttgagtccaggagttcgagatcagcctgggcaaaaaaatgagaccctgtctctactaaaaatcaagttagccagatgtggtggtgtgcgcctgtggtcccagcaatacaggaggctgaggcaggaggactgcttgagcccaggaggtcaagactgcagtaagctgtgttcgtgccactgtactccaacctaggtgacagagcgagatcctgtctcaacgaatggggttaatcctgaaaagaaatacaatatataacttgatctctacacatatgtagaaccatacacttaaattagagaacatgcatcctttttaaactaatatgcaacatttacgtaattttcctagattcatttaggcacaaaggaagtttcgacaaatatgaaagatatataagatatcttatctgaccgtagtataataaaattagaaattaatagtgaaaatataaccaattccccctccaatccatgtttggaaattgaaaaaaaaa

SEQ ID NO: 40863 - DNA, 950 bp, Homo sapiens
tcccaggtcacgaagactggaagtgtgatgaagtagatccacacatataaaagattatttcctgcaatattctattcctgatcagttttctgcttttcatttcatacaatgtgcaaaaggatgagagaggattctgaggttccatagcagctgggagccctgacctcatggaaatggccatccacatccttacttaatactttcaaaggacccagaaccaacaaatacacatctggcactctcctcccagggcaaatgaaggaggtgggaaggcttgagcacatttcagttcaacaagaatttcctgggctcctcctctcccagctgatgtactgctctagagaaacaaagatgtcattctgccaggtgggaggaaaaggtgaggtgggagggttaggtcaagtcccaaggtttggagaagaaagaggaggagggtaaggaggaagctggaggcaaaaactaccaatggtaaaggagatctggagaacagggtctgaaacagtctgacacgctctgtctttctcaaagagttgctcccccatggacccacttgccattgatctccgtttgggtcacttgcattatcctgtgtattacaccagtgttggcctgcacctttcgtgtcacgtgagtacctctgggagagatgtatgaagcccagtctggagtctaagcattagctgaataaagtgacaaagtctttctacaggtctccagagacctatgtcatcaaaccagctttgagataatgatgattaccaacccaccccagctaaaggggaccaggcagacaccatggtgggcttcagcaaggagatgaaacacagagaaaatgagttctacctaagcaaaaatactgtggacttaattttttttttttttttttttttgagatagggtctcattgtgtcacccaggctggagtgcagtaatgtgatcttggctcagtg

SEQ ID NO: 40864 - DNA, 465 bp, Homo sapiens
aaaaaaaattttttttggaataacttaaattctaaaactttgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaataca

SEQ ID NO: 40865 - DNA, 1204 bp, Homo sapiens
cccaaactcagcctcccaggtagctgtgattgtgcctctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaatacaaaaaaaaaaaaaaaaaaaaaaaaaaaaaaaaaaaaaaaaaaaaaaaaaaaaaaaaaaaacacaaaaaacaaaaaaaacaaaaaaagaaaacaaaaacaaaaaagaaagaaaacaaaaaaaagcacaaggggggcaggccgctcgaacacactcacgccgtgagcgggcaacgaccagccacacccagcacaccacatactagaaaagcgcggcgcacagagaagaatgacgaaaataaggaaccacaggcgacgagccggagcctagaaaacagcaaccacgcagcgaagaccaccacaaaacccgaacgcgagggcggacataacaaagaaacacacaacaccaacagggcggaggaggcagcaaaccaggccaaacacaccacaccccaacacaacagcaacgcccagcacgaggcaaaaactcacaacaacaacgcagcgaaggaaggacgagcaaccacccacaacacacgcacggcgcgaggagaaaagtgaaaccacggccaggaataacagcagaagacataataccgccggggaggaaa

SEQ ID NO: 40866 - DNA, 2241 bp, Homo sapiens
tgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggaccagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaataca

SEQ ID NO: 40867 - DNA, 3438 bp, Homo sapiens
tgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggaccagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaatacactcctccccttcctcacacttatttttatccttgttcgtaatatcctacttggcttcccattttttatagcagtaatatctaattgattgctaaagactgcaatacacaaaggcataaagcaaagcacaagtgctctccgtggggagaacccggccggcagctggggatgcgtcccacagctcctcagcatgcacacacggtcacgtgatttctgacggcctcatcctgcaccatgcctcttgtatccgccattttctttcttgctcaactgtacagactgggcattcacttaatgcttttctttttttttaagagagtctcactctgttgcccaggctggagtgcaatggcacaatctcagctcactgcaacctctgcctcctgggttcaggcgattctcctgcctcagcctcctgagtagctggaattacaggtgcctgccaccaagcctggctaatttttctatttttaatagagacaaggtttcaccatgttggccaggctggtctcgaactgccaatctcaggtgatctgcccacctcggcctcccaaagtactgggattacaggcgtgagccaccgcacccggcccacttcatgcttttaacctctgactcgcagctctcccgtgagcccacagacgggcacagtgacagcatccaggttgtcatctgtgcaaacagcatgttctgaatgtgcctgtactctgttcgtgcttctctttgcagctgtgcaagttcattcgcaaacgtcctagaagtggaactgctgggtcaaagtgcattccccaaatgtcctgccagaggcctggtcggcagcagcctcctgcacagcccgagtcccttctgcgagagtcctggcttgtttgcagcctgcagctgggagatttgaagtcagacttccaggattgccgcatggagctgcagagggagtgagcatggggctggaggacctgccccgccggctgacactcccacagcaaggcgggcccgccaaggaagcactccacatccgctagggttggggtatgacccccagtgacagaccaggaaatggaggtttcaggagctcaagagctcgtctaagaacatggagctcatcaggaggtaagccacactcagacgtgggcctgctcgatgctcaaacccctactgctgacaccccccacccccctaaagaggggtggcacagcggccg

SEQ ID NO: 40868 - DNA, 1890 bp, Homo sapiens
tgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggaccagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacaagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaataca

SEQ ID NO: 40869 - DNA, 2095 bp, Homo sapiens
tgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggaccagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccagctgtgcaagttcattcgcaaacgtcctagaagtggaactgctgggtcaaagtgcattccccaaatgtcctgccagaggcctggtcggcagcagcctcctgcacagcccgagtcccttctgcgagagtcctggcttgtttgcagcctgcagctgggagatttgaagtcagacttccaggattgccgcatggagctgcagagggagtgagcatggggctggaggacctgccccgccggctgacactcccacagcaaggcgggcccgccaaggaagcactccacatccgctaggtagggtttgtctgcatcttttcagttcttcagtttaagtcctgcctgggaagaaagcaaactccagaggcaaatctggaatgcctgtgtgccaccttctcaccgcaccacagactcccctgaggacgggttgtggcggggttggccccaagcatgggaggcagcgcagacatgcagaatggggtctgaggtcacgttgcaacgctggcaggatgtgtgctcaagggccagtctctgcaggggtcagggcgtgtgggccacgcacaaggagctggcactaagccgcttaggctgcaggaagacaccatctgcctggggcggacaaggccccatgtccgtcctcaaggaggctggtctggatgagaagggtcacagtctggccaggagtgtcaccgtgccc

SEQ ID NO: 40870 - DNA, 641 bp, Homo sapiens
gctgcgcagctgggaaggcgttcgggagtgggttgcgatgcttccctgtttgttttctcctgacatcgtttttgtttgggtccaggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggacgtaagtagctcgatctaggccgctgacccccagagacttgatgctgcgctgcagactgccgccgctgccggggcgcttgacttcccctctcctgacagcacgttcgttcctttgcagcagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcag

SEQ ID NO: 40871 - DNA, 510 bp, Homo sapiens
ccatatgtgtgtcctggaagccaggaaaagagatgtgtgctctaacagggtccagaaaaaggaggcaagggctcaaatgctggctcccctgagcaaaggacctggcaaagcgcagggcatggggctgggcctcccgcctctgctacctcggcctgccatggaactgatgccactgccagggaacagtcagaaagctcacggtgagcccagctcactggctgggctgcccagtccagccccacaagagccctctcctggggggtcctctgtctgtggtgccctggaatgggctgtgttcacacacacttgacatgtgcacacctccctgcagggttggggtatgacccccagtgacagaccaggaaatggaggtttcaggagctcaagagctcgtctaagaacatggagctcatcaggaggtaagccacactcagacgtgggcctgctcgatgctcaaacccctactgctgacaccccccacccccctaaagaggggtggcacagcggccg

SEQ ID NO: 40872 - DNA, 2243 bp, Homo sapiens
  misc_feature (1508)..(1508): n is a, c, g, or t
tgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggaccagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccacaatttctagaanattttaaatattattttatttatatttattatttttttttttttgaggatcgtaaccaggtagtgttgttgtgagtttaattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaataca

SEQ ID NO: 40873 - DNA, 2788 bp, Homo sapiens
tgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggaccagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaatacaaaaaaaaaaaaaaaaaaaaaaaaaaaaaaaaaaaaaaaaaaaaaaaaaaaaaaaaaaaacacaaaaaacaaaaaaaacaaaaaaagaaaacaaaaacaaaaaagaaagaaaacaaaaaaaagcacaaggggggcaggccgctcgaacacactcacgccgtgagcgggcaacgaccagccacacccagcacaccacatactagaaaagcgcggcgcacagagaagaatgacgaaaataaggaaccacaggcgacgagccggagcctagaaaacagcaaccacgcagcgaagaccaccacaaaacccgaacgcgagggcggacataacaaagaaacacacaacaccaacagggcggaggaggcagcaaaccaggccaaacacaccacaccccaacacaacagcaacgcccagcacgaggcaaaaactcacaacaacaacgcagcgaaggaaggacgagcaaccacccacaacacacgcacggcgcgaggagaaaagtgaaaccacggccaggaataacagcagaagacataataccgccggggaggaaa

SEQ ID NO: 40874 - DNA, 2358 bp, Homo sapiens
tgcggcgctgccatggagacacggcccagcggccgccggccccgccctgggagccccgcagtgcgtcgcgccgctgcccgcatctccgaggcccgcgacgagcggggcctcacgggagctggatgctcggagcagcaaggcggccctgggggccccttccggtcccggggctgacgcctggcggcgtctccgggaacccgcgccctttcaagcgccgctggctcctgtttcacagatggagaccctgaagccccaacaagcagcctccccagcacctcccagtgactgaaaaagctggcactgggcgcccgtctcactctccacccagctcccaggctgccccacgggacgtaagtagctcgatctaggccgctgacccccagagacttgatgctgcgctgcagactgccgccgctgccggggcgcttgacttcccctctcctgacagcacgttcgttcctttgcagcagcacctttggggagagacgagacctgaacaaacgctggggctggatccccagggtgggtcagaacagccgttgccctgaaagctggcccggacagatgcgtgcggggcgtgccaccggagctccttccagcttgcgtctggggccaccatgtcccttcctcagggcactggatccatctcttcaagctcagtggtccaggccatggtggcagaatcaccccccagggtgtgacgcctcgtccctgtcaattccacacagctgcacccggaagagctgtggccgggcgccgctctgacctgtgtgcggtcccctgaatgggtctcaggtgtcttcagaatggtgaggccgcctcatttcctcaccacacaaccctcctgaggacgttgcctgcaaatgggcggaattcctaatttctaccattcagttaaacgagggatccttaagccccaaagctgggaaagctgtccgttaatttagtgcgcgtgggccgtctcagaacagcagggttcccaggagtccagcgggacgggggaggggatgagtggccgtgtccccctggcagagaaggccttgtctgaaggctacgcccgcctccggtacagggacacctccttgctcatctggcagcagcaacagcagaagttggagtcggtgccacctgggacgtacctgagcaggagccgaagcatgtggtactcacagtatggaaatgaggccatcttggtccgagacaaaaacaagctcgaggtctctagggacacagggcagtccaagttttgcacaattatgtaattccgatgtgagcacctgaacccaggaccacactttgaggaaaacagacctgagtttcattcagttgtcttgttgatttccaatccttgctggaagattttgaataatgaacgtgaagatcaaactgtggtgtaagaacccaagaagcgcagaattggcccccgaacccctcagcacagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggcggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaataca

SEQ ID NO: 40875 - DNA, 484 bp, Homo sapiens
ttgcgggaaacactgcttccacgccgagagaactcgcttctcctaaagatatttttgggaagggaggagttgcagagagggacgggaggggagagttggggagacctcaattaatgctttaaagatctcttagaaattaacaaactggggagtcttggaatctgctgtcagaagcgtgttttcccctctctcctctaacaagcactgacagtctaattactgtagctacaagcagctgtcgaggcagcagcccgggagaggaggcgccacaggctgggcgcgcccggccggcccctgcgcccagccgaaccgccgaagcacggcccgactcggggaaggactcagggaggatggagaggggcaaggccccgcgcccgagaaccccggcgggcctgcgagccagcggacacgcttattgtttccttaagtctttaccttgaaggttaaaagatgtgacgaaaggaggggacgtggggggagtggg

SEQ ID NO: 40876 - DNA, 401 bp, Homo sapiens
gggtccctggggtaggagttgcctttgcagactacagagtgcacagggccagcaccctgccatggaggaggaggtgtcctgtcatccgccaggtcagggcacaggttggctcggccaggaacccatgttctgacagccctggagtaaggctttgggcatgggctcagtctcagggccacacgggtccccaagctcagccacagggtgcctacatccagcataggtcgatgctggtctccccacccttccccacagctgggagcagtgtgtgaagaagggctgtcagcttgttctgagcacaaaccgtgtcctcactgatggtccgtgctaatgtgaatttgcaaggttcttgcccttcccaaggtgcagagcaggaggtggggccaggaactgtgccctgc

SEQ ID NO: 40877 - DNA, 350 bp, Homo sapiens
tgggaggcaccatagtcttcttttacaaacgcctccatctccactccacccctgccagtttgacccacttccagtatttggcctttgctcaattctttgctcttctctttcttctgcctggaacatcctcatactgtctcctggcccatctctccttgtggagaaaaccacagactttaaagccagctggccctcctctgtagagcgctgcctccctgtctgtgttgggatggggtgggcccccagggatggaagcacccctgatgagacacactcaccccctctgggctgggcactgctgccctccaccccccaggaccacacctgggatcccaccctctctgccaggg

SEQ ID NO: 40878 - DNA, 354 bp, Homo sapiens
aaaatgatgccttttcaaagacatgcttgtaagtttgactcagagcttagaaaacttagcaaaggagtattttctttttccttaggggataagaagattgatctgaggtcagaaaaaattgagtttgagtctcattatgctactttcttttttgagacggagtctcacgcagttgcccaggcttgagtgcagtggcaccatctcagttcactgcaacctctgtctcccaggttcaagcagttctcgtgccttaacctcccaagtagctgggattacaggaacctgccatcagacgcagctaattttttttttttttttttttgtggagatggggtttcaccttgttggccaggc

SEQ ID NO: 40879 - DNA, 916 bp, Homo sapiens
ttttttctccagctaacatacttaaaatgcttccctgcccccccccaaaagacagctctagtatattatttctcttttcttttcattcacaatacaattgagataaaattagcttttttgcgtctttcccattactggtttacattcaatgttgtgtctttgaaacagttttaagcaatctccttcggggactttcccattgcttaccctggttagtctgtaacaaggatgggctatcccagtacagtaaagaatgctggctttagagaatggtcttaggtcaagaattattattgctcaaggccttcgagatctagttatgggtttctgcaaaccctgtgggctcttatgataatgcttttctccactattattgttataaggcattaaatcagtcagattcatgagcaacaagaggtcaacgtctgattgaaattcataaggtcaaaaaggaaactaaaaattaatttataagatatgaagatttaggttcaaactatatccatgagcaataaaatttcacatccataaatgtaagaaaatcagttattaaacttgaggggggaaagaagacttattaagttttacacacacataaggcagctaacacataattttatcagacattactgaaatcctgtgtgtaatataagggatgatgggataaaatgctaaatggtttagcactaaattattaagtgatgtatccctaaggtattaaacagatagaaaatgcagagcaggtgtctctcctagcaagacttgatcaccagtttaagtgcatattgataacaaatgcacttcagagagaaaatagtattagtaatatttttgctgcgtgaaagcctggtgtcaggatgactaaaagcttctccctgacaaagaaatgttcatttcttcttcttcttctttaaaa

SEQ ID NO: 40880 - DNA, 316 bp, Homo sapiens
ctgatttgggctgtgacaggaggtgtgaaacccagggtccagttctaccaccttcatttgcagatgcaaaagttgaggctcagagagggcaaggggctcccccagattaaacataaagtagatgcacagtgagaagtggaagccaggtctcagtctccccatcagtgtgtctgcccccatggcctgtgctccctcgccatgttaacgctaccatgtggcagctgcatcccatccaaggagggtgcaaccctgcatggggccatgtggtaaagcagcacttactgagtggggtcacagatggggccacatgctggaa

SEQ ID NO: 40881 - DNA, 357 bp, Homo sapiens
atacataccaatgggatgggaagcatttatcacctagctgggttcttacttgagctctgaaaaaaatgatttggccacacaacctttctcaaggctctgatttaatggacttctctgctgcaaagccactgaaattctttgccttttaatatttgacatctcttcctctttattaccatctcacacagcccttataggccagccagaacgagcccattagtctctgacaaataacttgtgtcgtttggtgaaaaatatgcagaagtttggctgcaacttcatctccagccttggttctgtttgtggctttcactctcctctaggcaaagcatccagccccaggcagagcctctttcc

SEQ ID NO: 40882 - DNA, 650 bp, Homo sapiens
cgagcggccgcccgggcaggtaccaacaagacactcaaagcaaatgctcactggagcatttttagattttgggtttttgaattcgggatgctcaaccaatgcaaatattctaaaatctgaaaaaatctgaaatccgaaacatttttggacccaagcatctcagatgaaggatactcaacctgtatctcttattttactcctgatgatttgtgtcttcttttttttgtgtcagttttgctacagttttacccattaagattttattttggttactgtatttttccagttataaagtttcccaattggtttttctttaccctatttatttgctatgctgaaaacttcctttttttttaatttatttcaagcatgttcataactgcttgttgaagcactgtcttgatgactcctttaaaatttgtgtcagggcaaggtgccatgactcatgggtacaatcccaacactttgggaggctaaggcaggaggatcgcttagcccagcagtttgagaccagcctgggcaccatagcgagacctcaggaggctgaggcgggacaatcattcaagcccaggagtttgagactgctgtgagctatgatcacatgccactgcactccagcctgggtgacagagtgagactctgtctcaaaa

SEQ ID NO: 40883 - DNA, 867 bp, Homo sapiens
gtgggcacctgtaatcccagctactcgggaggctgaggcaggagaattgcacgaacccaggagaaggaagttgcagtgagccgagatcacaccactgcactccagcctgggcaacaagagcaaaacttcatcccaaaaaaactaaataaataaagatttttaaaaagctatgtatttctagcaactgaggtctattctgcaactgagaggacactttaaccattttatttacatttcatctttatatgactgaataacattacatcaatcagaagtctttattggccaggagcagtggctcatgcctgtaatcccaacattttgggatgccaaggcaggaggattgcttgagtttaggagttcaagaccagcctgggcaacacagcaagacctcatctctactaaaacccaaaaaaattagccaggtgtggcgctgtgtgcctgtaatctcagctactggagaggctgagtcaggaggatcacttgagcctgggatatggaggctgcagtgagctatgatcacattactgcactccagcctgggcaacagagcgagaccctgtctgaaaaaaggaaaaaagaaaaagtctacaccttttgttattcctagctgagtaagtagtaccacagctgtgtcatgaagaattggcaagtcaagtcccagatcctaatgttgaaataaatgctggtaagataagctaggctgaaacgcagttagagccatgaaattcctgagaggaccatgttctgtcccaacatatgggagcccccatgtatttcacactctcctgtcttctccccactcctcagtcctcttctaagtcctcttagattaaatataatggagaattttttaagatgatgcaa

SEQ ID NO: 40884 - DNA, 487 bp, Homo sapiens
gtgaaaccccgtctcaaacataaataaataagaaaaaaaaaaaaaaaagaaaaataatgggtgggtgcggtggctcatgtctgtaatcctagcactttgggaggccaagacaggtggatcgcttgaggtcaggaatttgagacgagcctgggcaacatggtgatccgcccgtcttggcctaccgaagtgctgggatcacaggcatgagccaccgcgtccggccgatggcttcttttcttaaaagaacctctgctagcttccaaattttcttctgcaacttcctcacctctcttaggcttcaaagatttgaagacttagggccttgctctggataaggttttggcttaagggaatgttatggctggtttgatctatccagaccactaaaacattctccatatcatcaaggttgtttcactttcttatcacttgtgtattcactggagtagcacttttagtttccttcaagaacttttcctctgcactc

SEQ ID NO: 40885 - DNA, 422 bp, Homo sapiens
gtgagataggaagtatggtgggtgaggcacagcaggaaagggtgccagttcttcatcttccataaggggaagccaatggatagtgcccaaaactaaaaactaaaagaagagttacataaatatatgatttagagatacggaagtaaattccaaaggaatctgctcaaacaaaattgaaagcaattgcctcatgggtgtggaaaatgccaggataaatgactgcaatgtttcatcataagctttttggaactaaattagctctctaaattatgtgcttggagcacactgataaaagtaaaaacaaaattaaaacaaacaatagccctctggaggccttgacaccaaagagaaaagtcttggtagctgaaggactttaaatatgttttacatagaaaattgtaagtggtgcaattatacttcag

SEQ ID NO: 40886 - DNA, 2221 bp, Homo sapiens
  misc_feature (1)..(3): n is a, c, g, or t
  misc_feature (11)..(11): n is a, c, g, or t
  misc_feature (452)..(453): n is a, c, g, or t
nnngggtcacnttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcnnagccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccatcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaagccctctttccccaccccctcccccatctcccctttttgaatagataatggatccaattatccatataattcaataggtatttattgagaggctcccttctattccccatccctaatccctaacgaacccacgggcacacacttttggaaaccctggtaaagtaacacttagggggaaatggggacaaactggctctctggattagtgcgggtatagacacccccaaataggtgggtaggcccattgattcagctccttgcagctgtctctgttcaaaggaactgtgcagatttagaacgaattggagcttgagcttcacaccaccagcttccagagattaaagtttgtacaaaacattgca

SEQ ID NO: 40887 - DNA, 2039 bp, Homo sapiens
aagagggcggggcccccgtcgggtcccgggaaccgaacccgatggagaggagggggcccccatggatttagggggggaggggaaagtcatgggggggcacccccccggaacccctttcccaggcgcgcgttctccgctgaaagaggctcagagagacactttctccgggatcttaagtgtgggggctgctggctggggggcccgtccggcccaacgccggaggcttggaaaagagagttagcagcgggagcggactacgtgccgggccatggcccttctgcccgggccctggccacaatgacctctttgccctgccccctccccggccgggacgcctccaaagctgtcttcccagacctcgcccctgtcccgtcggtagcggctgcctacccgcttggcttgtcccctacaaccgcagcctcccccaatttgtcctactccaggccgtatggccacctcctgtcttacccctacaccgagccagcgaaccccggagactcctacctgtcctgccagcaacccgcggcgctctctcagcccctctgcggacctgcagagcaccctcaggaactcgaggcagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaagccctctttccccaccccctcccccatctcccctttttgaatagataatggatccaattatccatataattcaataggtatttattgagaggctcccttctattccccatccctaatccctaacgaacccacgggcacacacttttggaaaccctggtaaagtaacacttagggggaaatggggacaaactggctctctggattagtgcgggtatagacacccccaaataggtgggtaggcccattgattcagctccttgcagctgtctctgttcaaaggaactgtgcagatttagaacgaattggagcttgagcttcacaccaccagcttccagagattaaagtttgtacaaaacattgca

SEQ ID NO: 40888 - DNA, 2652 bp, Homo sapiens
  misc_feature (1)..(3): n is a, c, g, or t
  misc_feature (11)..(11): n is a, c, g, or t
  misc_feature (452)..(453): n is a, c, g, or t
nnngggtcacnttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcnnagccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccatcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtggggccagtgtcgtccttccccatctctcaccttccctggttctctgggaactcatcccccagccccagctgtgaatgactgatggattggtgctgtggccctgttgtcacagttctccagggaatgttcatagctggctcttagtaagccttggggggaatgtgttgaaaggtgtgcatgtatgtgcgggtggggtggagtgggtcaggaagaggagggtaggtcagacagggagacatggatactagctcagaggcaggaactcagaaggctcctggggctgtgggggactgaagcaaatgttcccagcctagggaactgctggtctcccaggactgtgcctgcacctggatccctttcccttcctcgaaacttttcacacatatcttcctcctgatctttcattctttccccttttcttcccgaaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaagccctctttccccaccccctcccccatctcccctttttgaatagataatggatccaattatccatataattcaataggtatttattgagaggctcccttctattccccatccctaatccctaacgaacccacgggcacacacttttggaaaccctggtaaagtaacacttagggggaaatggggacaaactggctctctggattagtgcgggtatagacacccccaaataggtgggtaggcccattgattcagctccttgcagctgtctctgttcaaaggaactgtgcagatttagaacgaattggagcttgagcttcacaccaccagcttccagagattaaagtttgtacaaaacattgca

SEQ ID NO: 40889 - DNA, 2064 bp, Homo sapiens
  misc_feature (1)..(3): n is a, c, g, or t
  misc_feature (11)..(11): n is a, c, g, or t
  misc_feature (452)..(453): n is a, c, g, or t
nnngggtcacnttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcnnagccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgctgcccgagagggcccagctggcagcgcagctcggcctcacccagacccaggtaaagatctggtttcagaacaaacgctccaagtataagaagctcctgaagcagaattctggggggcaggaaggggacttccctgggaggaccttctctgtgtctccctgctccccacccctcccctccctctgggatctacccaaggcagggaccctgcccaccagtggctatggcaacagctttggagcctggtatcagcatcactcctcagatgtcctggcttcgcctcagatgatgtgaatctggggaagggcgggtcaggcccacagccttcctgcaaagcccaggacccaggcagtccacctgcaccccttctgggctgggaggaaaccagctccagatgggttttctctggaggacaagcagttagaggagaaaaaggaatggagcagagcctgtacccctaaccctaacagctaaatcaaggacctcagccttatataatcattgtccccaccactaccatggactggacaccttcactccagctggacaaagactctggagagagagccattggctggagttgagactgtccccagaacccttggtcttgccactcccccactccttcttccctctctccctttctcctctccctgctttcttgaaaaggactgaatcgccactacagcctgggtgcaaaatcagcaagaaacattgagtatttttttttctttgtatgcctttggccttgcacaacccatttgtgagcaaaagcagaagtggaccaccatcagctcccacccacccagcgatttttccttggaggtcagcccgttacccccataactgatttacctacttaccatactgggaggtagaagagatgcagagaaatgtggaatttgtggacctatgggtaatttatgctttcctcctaaaaaaaaaaaaaaagccctctttccccaccccctcccccatctcccctttttgaatagataatggatccaattatccatataattcaataggtatttattgagaggctcccttctattccccatccctaatccctaacgaacccacgggcacacacttttggaaaccctggtaaagtaacacttagggggaaatggggacaaactggctctctggattagtgcgggtatagacacccccaaataggtgggtaggcccattgattcagctccttgcagctgtctctgttcaaaggaactgtgcagatttagaacgaattggagcttgagcttcacaccaccagcttccagagattaaagtttgtacaaaacattgca

SEQ ID NO: 40890 - DNA, 858 bp, Homo sapiens
tgtgcataatgtacagattaggaaaatgatcttctaattgagaagtatacttcaaagtttggaaataaaatcataaaaatgttttcctaaacatagcctttttcaggagtttttgtggatatggtcaaaggcaatagctctaattatctggggtcctcaggacaggaaatgagctcacactcatgctctcaaactgtgtcacagcatttttggaaatattttcatttctattcaagaggaggaacaaggccccaagtgttcaccctaattgtagaaaataaacataaacatgaaattcacaaaagaacaactataaatggctgcaaatatgtgaaactatgtttaacttcccagggagtcaaaaaatactaattaatacaagaatcatctttggcccaccacattatgattttgtctgaataagcctcttcaatgctggcaaatatgaggtaaaatggctgctccggctgctctttttggctggtcttaaggggcgcaaatagctccaccccatttggaaagcacttggcaatggctgctaagactttagtgtttttcatagcttctaacctgctaagaagtagatacttgttcccattttgctgctgtgcaaacagacttgtagaggtcaagtatctcgtacaaggttacattgatggtgattgatggcgccaagatttgaacttggttgtgagtccaaagtctaggtctcccattctacccatgtgattttacacacatgcctgatataattagctcctcctcctctccagagaagggcagctgacctttgtttccccagttcagaaatcctggtgtgagttatcagctggggttgagggtggatagatttgttcc

SEQ ID NO: 40891 - DNA, 560 bp, Homo sapiens
tgtggttattgttcaatgacatgttgttgttcgaagagtccctaattggtggcagttgaatatattgttgattattagcaatgactaattctgtccaagttttaatattcaagctaaaagtgtcagaagaacatatttaattttcactttgaaaaagaacagggtccccagttttcctaatgactggaagagaaggaagtctccttaaaattttagcatgcaatttctaggcataagattttatatggtacttatagaaatagtttattcctgctgattttagggataattattttctttgcttaagctaaattgttctaggataaaatgaaaatgctggaattttccaaatgttaaagttccatttggaaacgtgtaaatcccaacagtatatataacctaattgtgatagacatgtaagttttatttgttttttaatatctggcccccatcagatgtctgtatgttaaaccccccttctcagttggtggtgaatgatatctggattagattatataatgttatctatttttaaaaattaaagccttatttcagtccta

SEQ ID NO: 40892 - DNA, 404 bp, Homo sapiens
gaacattttgaggaggtgttgggactctaggtggttatgttgatttgtgcctgtgagttctacaggtacagaagaatgttttaggagaaggggataattgggagatggggtaaaaattgggatgtataggctgggcacagtggctcacatctgtaatcccagcactttgggaggccaaggtgggcggatcaccaggtcttgagatcgagaccatcctggctaacactgtgaaaccccgtctctatacaaaaagttagctgggcgtggtggtgggtgcctgtaggaggctcctactcaggagtctgaggcaggagaatggcgtgaacctgggaggtggagcttgcagtgagctgagatcgcgccactgcactgcagcctgtatgacagagcgagactctgtctca

SEQ ID NO: 40893 - DNA, 185 bp, Homo sapiens
ctgtattctctagaagttacatctggaccgtatgtctgctagacggccaaatggccacagtgaatctccttgctttccttcttgcttctgctaattgaacattctctcctgctttctcttttttacctgtgctgcagcctgagactcctcacttctgtcctcagctcttgcttctcatcttatcc

SEQ ID NO: 40894 - DNA, 371 bp, Homo sapiens
tgaaaaaagcaaagcagaaatggaagaataagagaaccagagtataatcaaattgctttaaccacaactgaatttcactcagatcctgtgcacaaacatctgcttacttcatggccaccaaggacatacagaaaatgtaacacagcctttactaaaggccaccattaaaataaaaataatcctgcttaaagccaggagttcaataccagcctgggcataaagcaagaccccgcctctacaaaaaaaaaaaaaaattaattggacatgctggcactcacctgtaatcccccctagaaaggaggctgaggagagaggatcacttaagcctaggagttggaggctgcagtgagctatgatcacaccactgcact

SEQ ID NO: 40895 - DNA, 307 bp, Homo sapiens
acaaaacaaaaatcattcgttggaggattacataacaggatccagagtgtataaaacacaacatccacaatgtccagaacacaattcaaaattacttgacataccccaaaccaaaagccaaacgggaaaatgtgaccctttcttaagggaaaagacaattaacagatgtcaaccctaagataagctagtttgggaaccctcaacgactttaaagaacttgttgtagctatattccacgaggtaaaggtaaaatgcatgggaatactgacagtgacaacctcagcagagacacagaaactatatataa

SEQ ID NO: 40896 - DNA, 347 bp, Homo sapiens
tgcaagaaaaaatcttgcaaaagtgttggagcagtggtgggacagtgatgtggtttgaatctatccctgctcaaacctcatgttcagttgcgatccccaatgctggaggcctgttaggagataaatggatcatgggagcagtttctcatggtttaacaccatcccccttggtacttctgtcatggtagtgagttctcgtgagatctagttgtctaaaagtgtgtagcacctccctgctctcttttcctcctgcttcggccatgtaagatgtcatatttcccctttaccttccgccatgattgtaagtttcctgaggtgtctcgagaagccaagcagatgccaccatc

SEQ ID NO: 40897 - DNA, 196 bp, Homo sapiens
gaaaattatggcttaaggctcagaagttctcagtcaggatatccagcttcctaccacaagcaacacatagaggcatttagaaaatgggcggagtgttttgttttttaaataacttgggctgggaggctggtgctgatgactattagtagcactcccaatcaaggaagaattttttagccccaaatgccagtagtat

SEQ ID NO: 40898 - DNA, 642 bp, Homo sapiens
atgctggccaggctggtctccaactcctgaccttgtgatccgcccacctcagcctcccacagtgttgggattacaggcgtgagcccccgcgcccagccaggactttgtatttttacggtttcctttattgaagggaagaagtgtttgtgaagttgaattattcgatatttagtttggcgttaacttagggtgtggaacaacaataccaaatataatgaattgtggtttttctaaccagtgaattcatagttagaattagatagtatttgaagggtttcagttgtatttttagatggcataaatggcttgattctttaggtatttaattgcatgggattttgaaataagatagtgtaatccagttaacggtttgctttatatcatattccactgtttttaggtttaagaattttgcttgaaatgtcaaacccttaggccttgacttggggtctgttacaaaaatattttgtgggggagaaatcatagcttttgtctttgaggttcatcagttatagttacccctgggggcctgggatgggaaggagacctattttcactgtgcaccctgttggactgttgaaattatttaaccaatatgtgtatatttccatatcaatattttaaaatttttcaaaaaaaaaa

SEQ ID NO: 40899 - DNA, 275 bp, Homo sapiens
tcatgggggctttggttgtccctctcctcttttggctgctgtgttaataacacgctccaagaggacagggtggaagcaggaagaacagctagaagaccactggtgaggtgactgtggcttggagcagggatgtttcagagcaggtgttaagacgcactgggggctggccacagtggctcatgcctgtaatcctagcaccttgggatgtcaaggtgagtgggtcactttgagctcaggagttggagacctaagcaacatggtgaaaccctgtctct

SEQ ID NO: 40900 - DNA, 399 bp, Homo sapiens
aggatgatgctgtagccagaatctaggccattacctctactgaaaattaatccagtcttgtgtagagacagggtctcactgtgtcacccacactggagtgcagtagcatgatcctggttcactgcagccttgaattcctgggctcaagccatcctcctgcctcagcttcccattgggaccacaggtgcatacaactgatccatctacatttctttcccccatagtgtcagggtcttggtatgttgtccaggctggtctcaaactcctggcttcaagcgatcctccttggcctcccgaagtgttgtgattataggtgtaagccaccacacccagtcttaacttaaatctccacttttcagtaacatgaaaatttaaaaatctcaagtagaactggtataa

SEQ ID NO: 40901 - DNA, 978 bp, Homo sapiens
tatatttaatttctcagtaattactggcccaaagtaaaagaaaacaataacccatgttacatgggttactgttattgttttaggcctgatctgtttagaaaggaaagagaaatgaaggaaatagatagagaaggacagcaaacaaacatattatgtgggttactgttattgttttctttttcttttggccagtaattactgtggcaaaaacaagatgtggcaaaaaacacaatcctggcacagaagtttgtttggtgatggccatcaggttatttacttcaaatggttcgggtgaaaagaaagttttgtgtatagaaagagaaaaagcaaacaggtaaaatgttaactcttggcaaatcactgtgctattgttgcaacttttttgaaggcttgaaaattgtcaaagtaagttcttatcttaaaaataaaattttaagatctttcaatttttaaaaaagaagatagattttacttgccaacagagacatctagttctctaggactaactgccaatgatccgtgggctcagggcaggtgctggcctggaaaggcactgcttgtgctgtccctacctaaccatggcatttatgcccaacgaaaacccagctctttccaggaaaagcaggtagaacccatattcaacgctgccagaccttgctgtaaattctggtcagctgggaggaaatgtcctaactcatgtacatttgtcataaaaccaagaagtataatctggtacaaccttccagaacacagattgggagatgaatgcagcgggtgcttggtccccactctgcggctctggggagagttctcccaggacatacccttcccctgacctgggactgagcagctacatttgacacaccttgagaaagtcacctgggcctaaggcttagtaccagcgactcagccttgtggctccaggtgatttagcgtcattcactgcataaaatgatgcattaagaatgacttcaatat

SEQ ID NO: 40902 - DNA, 421 bp, Homo sapiens
gacataaaagcaaaggtccggggcctcattcccagaggccagggtcatttgggcagcaaataacaaatgccaggaatccacacatcaactcgcctgggctggggatgggggtgggggtgggtaggactctgagcacgtttttttaactcaccagaaaactttctagaaaaaaaaaaaaaaagcccaagggcgccacatggctagcctttgcttccaggccaagggtaaaagtctttgctgtacctccaagaggccagcttggacctcacaggataatgaatttgccctttctggcaggaacaggaactcagaaaagaaattggccagaggcctggtggttaggagattgtttctgaaaaaatgcaatcatctaatagagaatctgttgagcttagggtttcttgtgtgggactcagttact

SEQ ID NO: 40903 - DNA, 292 bp, Homo sapiens
aggtattaattttagattttatttaatttagaaaacattttatagttaaaataagggctgccaatttaacacactaatgtcagggtctaagtggtaaaacttgaacctaaaataagaatttttatactacctatgataaatatataatataagaagataacttatataaacaaaagttcaaaggggatccacaagttattagtaatggttatgtctagagagtggaattatggacatttattttcttttttccttattttctataattttttacattatgtattacatactt

SEQ ID NO: 40904 - DNA, 1964 bp, Homo sapiens
tcgaacgtggattactaaagctctattaagagtgtggagatccctccaagtttcccaaatgagaactcacaggaaaacaggactgaactttgagaatgttgtttatcgcagctttgcacataaacctgagtgtctcccagcctgcctcggttctcaccagcctgccagccttttcaccagcctctctccttagccttatggcctttcacggctcttctccctgccccagctctgctgcccgcccttcctcacgtcccctgtgagctgcctgagccattggttggatttcgatgtggctcattgcagcatgtggggcagcgcctcccatggcctcgccttggtgccggtgaaccccttttggttgcacacatgctccccacacacacatagacatcagccttcctgtaactgactggggacccagagtggaaacaccaggatggatcagcttgtctgcagaattgcccatcaggaagaccaaaagccagtagctttgctgatctgcccccaggactctggaggcgcccctgcactcccacctcccacctgccagttcccagacccacccattcgggatcacctggaccagttaccccaagtcctgcatctcccttccctgcaggctgaacaccagggtcatgccagtcccgccagccgcctcctccatgccccagtgactggtgtgggcagagcaggcagccagtggagctgtgggccagttccgctcttggatgctgctgctctcacccatgaggtcaggggggccctccaaggttatctccaggtgaggggattcacatcaggccacaagccaccagaggccttctgccacctcccagagcgacagccagggaggctgcgtactcagcctcggggagaaatccccgtgggacctgagccccaagacctacggaccactcagccttaccatcgtaccgtccaggattgtccttgccatctttgttgtctcagccagaccttggttttcagtaaagccccagtttctacttcctgcatgccactgtgcaaggccactcatcactgttcctgcagaagcctctggacgtggggctggatggggttgaaaatgttacatgtaaatattggtttggttcggtttttagcattttacttggtaactggttgttttcttttttggggtggggggattggtttgtaaaaattctctactcttttggaatgtgatttctaagtttgttggtttcttcaaatgccttttaagtcttggtaacattcccaaagcagaaaactgcctgacccacagtggggattccctggagaattggggtcccaagaaggaatgctgcccttctcgaacccgttctcccccttcctcctgcctctctgccttttactgctattcccttcttctcctcctttatccttctttctgttttccccatctccactctctcttcaaccaaagtcccaaggaaccctcggggctcaatcccccatagaccacttggcttgggtccatggggttggcatcagttggttggcggaaatgggggaccagttggcatgatggccctaaactgggaaacctcatgtttcttatgtctcacctctttccagagccaaatcagccccttttggaatgatgacttcattggaatgcaaatcaagtcattttggtgcatcagtggctcttaggcctgcacacacgagacatcagaatccaatcctctgaccctgtgccagccctttcccccagtttatttcccaccaaaggctgacctctaagaggtcttgctttctatgaactcaagatgggtcccacctctaggtgtccccaggtgcactcttctaccggttggcttccgatgtgacaaggccaagggcccaaagacttgaccctcttacacccttgctgacatggttccatcatgtccacccgcatgcacttttatggtttcatcacccagcctcttctcctctgg

SEQ ID NO: 40905 - DNA, 574 bp, Homo sapiens
  misc_feature (569)..(573): n is a, c, g, or t
aagagccacgctgtcttgcctgaaaatgataatgtgtgtccatttggtgtgttgatttgtatagaatcatttttcaaatggctacctttgtcaatcatcagatatttatagcctacctcctatttgcggtataccatacaagattaataatagacttgaggatgaatgaggtacatgccaccattgactcctggcttctgcgtcctgcttaacattaggatagcacaggagtttaaataaacagccacccctctgtcgcatacgccctggctcacactcttctcctgccatgctttctcacaggctgtgttgtgacagggcatccaccactctacctttaatctgacctaatgttgcttatcttccaagattttgctgtattgtctgtttttccaggaatactctgcaacatacttccatcacctagttttatgatgatctattttctatgttcccctgctccctaaaacttcagtctccttgagagtggaaactaagtcttattttcattacatctctagttcttaacagtttttcaaaagatgattaaacagtgactgtagtaaaannnnna

SEQ ID NO: 40906 - DNA, 600 bp, Homo sapiens
  misc_feature (2)..(2): n is a, c, g, or t
  misc_feature (7)..(7): n is a, c, g, or t
  misc_feature (24)..(24): n is a, c, g, or t
anctttnccctgtggttgtaaatnggctcttttcttctactgtattttctaattgttcgttcatatatgggacagggttttaaaattttagtctatagcaggtcctcgaaagacgtttcattcaactttgttttgttataatgttgatgagaagaaaaaacaaaaagtctcagctgaggtcactgtctgtgtgaagctggctcattctcccatctttatgggtcttctccaagtactccagtttcctcccatatcccaaagatgcacatgaatggatgtgtctacgcggcccagtctgtgagcgtgggtgtaggtgagagcaccctgtgctgggatggcgtccagttcagggctggttcccaacttggactctgaattgccaagaaaggctccagccattgagaccctgaactggaagagggaggcaaataattatctttttattaatctttcttaaatgtatacacagctcacattcattcaatttttttttgagacagggtcttgctctgtcaccgaggctggagtgcagtggtgtgatcacagctcactgcaacctccacctcggtgacagagcaagaccctgtctcaaaaaaaaaa

SEQ ID NO: 40907 - DNA, 396 bp, Homo sapiens
tgtctcataaactaaggagagatagctatgggaacatagtcatgaagataattatcgatttcagtgtctttaccctggcctcctaaaatcacttgttccaagctctggtttttttgttttgttttttgtttttgtaagagccctcaggttagtgattctctctgtccctcctctgagttgaatagcattatctcagcacttctgggagagttgttaaggagacttccccctccttctgggtgcccctagggaaatctgattaaaagatttttgtttatctagaaaagtgggtgatattttaaagctttgccttgtctgtttatgatcacaagctaatacttctgaggatgataagggggacaaacaagatgaagaataaaggaaaggaaacacttt

SEQ ID NO: 40908 - DNA, 1736 bp, Homo sapiens
tcttaattttacaagcgaggaaatgagagtgtttcttgtaggggtgtagtgagaatttaataaaacagtttaaggaaagaaaacaaaaggtagtattgctgcactttctagatggtaaaaagcaaaccaccatgtctgtttaatatatatcacctgctggtccctcggtctagcaggctgaactgtgtgcctgggaattttcttctcgctgtgtgcacccctttacgtcacagggtggactctcttcagagtcctagtggagcagctggccaggctgacatgatctgacaacattgtaggttaccactaccatctctcaccgtctcactttcttcgggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaa

SEQ ID NO: 40909 - DNA, 1804 bp, Homo sapiens
tcttaattttacaagcgaggaaatgagagtgtttcttgtaggggtgtagtgagaatttaataaaacagtttaaggaaagaaaacaaaaggtagtattgctgcactttctagatggtaaaaagcaaaccaccatgtctgtttaatatatatcacctgctggtccctcggtctagcaggctgaactgtgtgcctgggaattttcttctcgctgtgtgcacccctttacgtcacagggtggactctcttcagagtcctagtggagcagctggccaggctgacatgatctgacaacattgtaggttaccactaccatctctcaccgtctcactttcttcgggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaatcagctgtaagaatttgtctcaccagaaaacaaaacattgcccattgtattaaaatttaaaccatatc

SEQ ID NO: 40910 - DNA, 958 bp, Homo sapiens
tcttaattttacaagcgaggaaatgagagtgtttcttgtaggggtgtagtgagaatttaataaaacagtttaaggaaagaaaacaaaaggtagtattgctgcactttctagatggtaaaaagcaaaccaccatgtctgtttaatatatatcacctgctggtccctcggtctagcaggctgaactgtgtgcctgggaattttcttctcgctgtgtgcacccctttacgtcacagggtggactctcttcagagtcctagtggagcagctggccaggctgacatgatctgacaacattgtaggttaccactaccatctctcaccgtctcactttcttccttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaa

SEQ ID NO: 40911 - DNA, 1634 bp, Homo sapiens
ggggctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaa

SEQ ID NO: 40912 - DNA, 282 bp, Homo sapiens
cacaaataagtagcatgaaaagtggagagggggatataaattaaaagagatttaagaaatacatcagccaagctcagtggctcgtgcctgtaatctcagcactttggggggccaaggcaggtggatggcttgaattcagaagttcaagatcagcctgggcaacacaggcaaaccctgtctctataaaaaaatatgaaaattagctgggcatgatggcatgtgcctgtagtcccagctactcaggaagctgaggtgggagaatcgcttgagcccaggaggtaa

SEQ ID NO: 40913 - DNA, 501 bp, Homo sapiens
attgaaatagcaatttgtttaccaaaaagtgtgatatacaatcagcaggaatcatagcactgatactcacattttacatcataaatgttttaaaaatgacattctcaaatatttttattgttgaaaatcagacatggcaagaatcttaattatggctaatctggacaagacatttaaatgatcatgaattatgatggggcaaacgcttctaattcatgctagcgatgtcagtattcctcagtctcttaaaataagttatttcatgtgattaatagatgagaaaagaatattacattttctttttatgcattaagagtttggggcaaagccaggcacggtgacccatacctataatcccagcactttgggaggtcaaggcaggaggatcatttaaggctaggagtttgaaaccagcctaggcaatatgacaaaaccttgtctctgcaaaaatacaaaaagtagccaggcgtagtgtgcctgtggtcccagctattcgggggt

SEQ ID NO: 40914 - DNA, 1750 bp, Homo sapiens
gcattttatcctttaaccacaaaatgtgtttaaaagctatgcaagaattagcaaaagtaaactacagcaatattaaaatgacttatttggtatcacctttacagacccagctcacttaggcaatggtattctagtaaattacaatattttttaaagcatagttttttttgttacctcttgaaatagtgattttaaagccaaaagggtcaagagtatgccaaatttaagatgattatttggaaaagagagatatcagcaacttaagtatgctgtatttaaggtgattgtaaaagagtttttttatatacaggacagcattaaaacagaattacaaagtctattaaccataatgatggagttcaagatgcagataaaattaaatgattgtctttaagctttcaataaatttgttagccaatttaagaataattgcagcttatgaaagcttgtttatatttatctaatttcaaaaattaagaaagaattaaaggatatttgaagttcttattatgtagtttctaacattgtgagagaatggtcaaaagactgctatgtcttatttagtgtaaatgtgtacatactttacagttaaaggaattactgctttgctaccatcaaggtcttaaaaccctgtatcaaaacaacctagagatttgcttcattaactcctgttcatttcgcagggcaagaaataagatcctctttggcaatcacgtgttacctgaattatatttaatctctttattaccttggaaatataccaagacactcacatattcacatacacacagcacacacacatacaaccctgatgcaaatatggacaaaatgaacaccctcacttatacatcagtccatttcttcctctcataaattgaatgtgaatagctctgatggcatttctctctgactgaaaaataaggtgccatgcttactccatgcaaagcccctgttttacagttttatgcccctcactaaaaatagataaatctgcatttgtatgtgtcctctactcagcctccctcatgccgcctgacttcttgcagaaggtgtatatgcttttcattctgaccaataagaggcaacttggtgagttatagagattgactgggtgcttgacatgtggtgctgctccattaaaacagtgggcagttggtactggggaggtttaggagaatttaagttgtctttattgttattagatgtgctcttagatgtggtaatattctaatattctattaaaaaatataaaaatgcaacttcagttcacattataataggttttctcatattgcttttgtggtccagatgtgaaacataacaataataatatgtaattctataatcatcttctaatgttaccaggtaatttttgtagacagagccagataaccctattgctcattatttaagtgcaaagtacattttttcaatcattattgcctaagaaatttttaggagatgatggttgaatggtccttctcctcacctcaccacaccaagataggttggtatgtgtgtttgtgtttccttgctttcactttttaaaggatcctatagaaaataacagtattgtttccatttaaaaaaaaaacttgataatttatattccattttatttctgaaaaatagccacatttttacataccccaaataaatcgccatgtgtaactatgtgcaaaaaataattgaatgtggctgaaaacgatctcacttgttgtactataatgtatgaataataataaatgta

SEQ ID NO: 40915 - DNA, 858 bp, Homo sapiens
  misc_feature (847)..(847): n is a, c, g, or t
  misc_feature (854)..(854): n is a, c, g, or t
cactgaaatagcaagaataaagttcttttctggccaggcatggtggcttaggcctataatcccaacactttcggaggctgaggcaggagaatcgcttgagcccaggagttcaagccagcctggacaacatagtgagaccctgtctcaacaaaaaataaaatattggctgagcagagtagcgtgcacctatagtcccagctactttggaggctgaggtgggaggattgcttgagcccgggaggtggagactgcagtgagccgtgatcacgccactgtactccagccttggtgacagagtgagaccctgaaaataaagggtttttttcttcaaacattttgatctgagccaaagcaaagagtacattagaacagaccagaaagacgtgtacaagtagacctgtttccttctcaaacatttaacaatttacttattaaacattaagctgagtcagtttaaatcaaatgatataactgattattactccaaacaggaatctgttgtttcttagtgtctgtaggtagaagtttcacagatgcaaggacattatttacctgaaggatcattcctgttacaattagagggcattcatacaaacattgtttcctgttttatttgccttttaaaatcgtgaaacatgacatgaagacatttccttatgtaattacaaaacgattagtacacctaacacaattcacaatcattccttactgtcatcatagtcaaatgaatgtcattatattcagatgttcccaatttaactaaaaacatatttgaaaaattatttacaaataaaaaacatttttttaaaatgcagggtcttgttccagcctgggagacagaagcganctcctantcaa

SEQ ID NO: 40916 - DNA, 838 bp, Homo sapiens
  misc_feature (837)..(838): n is a, c, g, or t
ggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggactccctgtaatctgagctccagttactacttaaggtgtttcctgaacgtactactgcatttcctgttttccttttttctttggcattctctggaatgcaaggaggagacttcatttacttcccaataaacttcatttctctggcataaaaaaaaaann

SEQ ID NO: 40917 - DNA, 1723 bp, Homo sapiens
  misc_feature (1722)..(1723): n is a, c, g, or t
ggaaaggaaactatgctgtatgccaagcccccacccacaattaatggtataaaaggactgcagaggaaggagagactcaaacctgcccacatccacctccagcagcttacctgcttttccattacctgttccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaagattctgtgtgccaaggctgagaatgccaggctggtggtgaacattgacaatgccaagctggcctctgacgacttcagaagcaagtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaattaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataaaaaaaaaann

SEQ ID NO: 40918 - DNA, 564 bp, Homo sapiens
tgctgggattacagacgtgagccaccgcacccagcctattttttttttaaggttaacttaaaaaactaatctccatgttctacctaggaaaaggttaaacaagaggcagaaataaagcagaaaaagatctaacattcgagtttaaaaaattctaatataaagcaaaataaaataagtcagatcacaaaaaaagatgtatacagaaacatgaactgtaagaaacttaatggcaattcggtgctggtttacaaatacagtaatgttagaattttaaaactaagttagatgacttcaattttaagctttttgatatggggatttgtgtactttggacttcaactatgaactaaagcaatttaaaaagaaaaacttaaagtaactttaaaggaaaaagtaatctctagcacttcaaatctgtgctattatctggactttgatttcctttaattcatatagactgttaaactaaatatgcaatacaattctgaaaaatgttcataataacagtatctaaaatccaagaacagttgaaagaatagttcaactgccccacaaccaagaagg

SEQ ID NO: 40919 - DNA, 278 bp, Homo sapiens
ctcagcctcccaagtagctgggattagaggtgcctaccaccatacccacttaattttttgtatttttagtagagactgggtttcaccatgttggtcccgaactcctgacctcaaagatttagctttgctagatgtcaccttttgtgagcattttaaatggtgtttctaatgcctggtgaacattgcataacagtcaagccagcagttaagtagcatctccatcttttaaaattaagattggattctggacctaagtatttcagtttcatcttctcaaa

SEQ ID NO: 40920 - DNA, 428 bp, Homo sapiens
ctcactaaaaataaaaaaaaattagccaggcgtggtggcacgtacctgtagtcccagctacttgggatgctgaggtgggaggattgcttgagcctgggagatcgaggctgcagtgagctatgatcacaccattggactccagcctggatgacagatggagaccctgtctcaaaaagaaaaagaagaaacgtggctttcagagtatgctttccacaagcccactaggggttgctctctgcccacacagagccaattctgagtggcgaggcctcccacctagaagtcttctttagcacaggttccacagctaaaataagtccagagcataatttaactctggtaggaaaccaccccagggtattcactgaccatcagccggttctttttccatctaggaataggcataaggatcaaacacacaaggtcga

SEQ ID NO: 40921 - DNA, 346 bp, Homo sapiens
gtgcctcagcctcccgagtagctgagattacaggcgcacgccactacacctggctaatttttgtatttttagtagagatggggttttgccatgttggccaggctggtctcaaactcctgacctcaggtgatccgcccgcctcagcctcccaaaatgctgggattacaggcgttagtgactgcacttggcacccaggaagatttaagcaaatcagtgttggtcttaaggaaagggaaagtttaacatagactggtgcaattcatcagtgtgaaagatgattccagctattcctcaaaaggaataaggaacagaaaagtgtgaggttggggatggagttctcatgcat

SEQ ID NO: 40922 - DNA, 393 bp, Homo sapiens
ggtggcccttaatcgccccgatgtacactgtcacccagtggttccagaggccaaacagtgggcgggggccacagcctcctcctcaactcagaggggagataggaacacatcatgccagctactccctgagcctgcagttggctcaaaacaacccactaaggcaagtgctggcatcccattttctgtaatgagccactgaggcgcagagaggccaagttcttggcccagagccacacagcaaggatacaagagccaagatctgaacctgaccctgtccatctgcccttctccagcgtccacccttcgcccctggaccctgaccctgaacctccaagcccacagccctgaccccacaatggtctcatctcaataccagcctcgaaaacaaaaaaa

SEQ ID NO: 40923 - DNA, 437 bp, Homo sapiens
cacttaatttttattttttttctgtatttcaatggatgcagttaaaaaaatgttttttttaaagagttatggtcttgttatgatgcccaagctggagtacagtggttatgcacaggtgcagtcccactactcatcaggacaggagttttgacttgctctgtttccaggctggtctggttcacctctccttaggcaaccttgtggtccctcacgtttatgccgaacttagtgcagatacccaattgacttagtgcactatagcccagcatttctggactcaggcgatccttctgcctcagcctcccaagtagttgggatcacgggcatgtgctctgcgcctggcaggagtttttaatatggtctttaagacactgaataatttggcttctcacattcatctagaaacaataacaataatagcaaccccccaaaaagga

SEQ ID NO: 40924 - DNA, 382 bp, Homo sapiens
cagcgccagagggatggggctgcactggagattcacaacaagggcaggaggcgagggggcccagttgcctcagaggcgcgcatccatggggtttaaagcagcgcactgaggattgagatttaatcttctatttgggaaaccaaatcccgtctttgtattctacaaacaagaaagcaggacgttccgtttttgtttgatagaaaggacggtgggtttaacagggccaagaatcacaaggctgcatgcttgcccttgaaggtccaataggacaggctagctggcttgtccccagcaggcagagggactccatggacgtttccagcctgaaggtggctcccagtcgtgtgcgatggggactttccatagttttgacacattccct

SEQ ID NO: 40925 - DNA, 393 bp, Homo sapiens
attagtgttacacagttattgtgattgtgtgctaaaaattataaacattcatctgcaaaacagaatgaaatgtccagtacagagcttggttcaaaatcaatgctcagtgaacatcatttcccctcctctcccacttatggctcaggctattactgtcattgtagactagcattaaaaacagtgctatattagtgctatatgaggaggtgcaaaagaaggatattggtctaaatttatactgagctaccttacacatcactgtcagattaatctgtgtaaaatatagctattttgtttctctacttacagctttcaaaggcttcctactatctgcaaaatagaacacaattccttggcctacttctccagtagtatcaaattacttttcccaaa

SEQ ID NO: 40926 - DNA, 171 bp, Homo sapiens
atgttaagagcacacaatggaaaaaggatcgtctcttcaataaatggtcttgagaaaactggatatcaatatgcagaagaatgaaattggacccctatgacatacgatatgcaaaaataactcagaatggataaggcttaaagataagacctgaattgtaaaattgctcga

SEQ ID NO: 40927 - DNA, 100 bp, Homo sapiens
cagtgtgagtctcgtggcccactcatcgggcgcagtgccctgggatgctccttgtcaccatgcacagtgggacatgtgagaaaccccaactctgcatcct

SEQ ID NO: 40928 - DNA, 2216 bp, Homo sapiens
  misc_feature (2050)..(2050): n is a, c, g, or t
gaatggggtaacctggctaaatgagaattaatgaacccacactcataagttttcattgacttagcaccaagtcgtccatcaaatatcatcagatctgagaatgctcttatggatatctgatttttagaggctggcattcatatttttaaaaactgccacctgtgaccacactgcaggccaaacagaatgtacctgctggtcagatgcagcccagaggtcactgaattgcaacctctggactctcggtcagaggcaagcagcccttattccagaactccacagtcccttcacacccttccccagacctacaccaagaccaactaagtggtcaaaaggtggacaaactgagagttgtatcaaggcccttagcctctcaatttgttatcaagtttccctttctgaatctatttaccctgaagtataaatacccaagatgagccttaagagtgcctggtagagcaaacaaagatgcatcttatagggagcaaagtctatgctaacgcagtgtttctcaatcctggctgcacctttgaaccacgggagctttaaaagtgaccactgcaagggccctacccactatggatcccaatttcattggttgggagaggggccaagtttgtttccaacttccccagatgactctaatggctgagagttgcaatcaacaggtaagtgaatatccaggctgtaagatgaagaaagagggggttgtgcccaagcccactgtgcctcataaagcagatgatctctgcagcgctgcgcttctcaaagagtggtcccaggactgcctcagtcagaccacagactcctaagttcctcctcagacttcatggatccaagctctgtgaggtaattctaagcacattaaacttgtagaacagccatctggatttaatattacataatagctataatattctgctattctctaatcttcaatgtcagtttcttaaactgtcaggcctgtctttagatgcccttcaactgtgctggggactatcttgatggcagccagcaaagaaaatcagcaaaaaccccagtggagtttctgggttttacttttgttaaggaaggtgatggtttcttgacatgacaggtatctaggtggaaagggcaaagtgctaatgcaaacacaatggagacactatggaatagctctgcctagggacatgtggaagagcttctaggagacagtgtggacctttccatccctagaggtcttcacaagataaattcctacctccgtcagtattcaaaaggttttagcatcaatactgtctgagaataagacattagacttgagtcagtcccctggcttcaatcccaggatgccaagcagcctctaatggagaccgctggcttaatcgtgctcctttcctggcataacaactcactgcacccatgcctcaccaccacgaagcagtctcctcaccacccaaatgtgccttgggtgacttaaatacagccattagtatgaatggtcccctgtttttattcaacaccacaccagtctttgcttttaccttcggctaatgtggttccagccttttatcctgcactccttcttataatttaaaaaaaaaaaaaactcccctactatctttatgttaatattaacatcaactaggttcttctcaaaggacagccaggcctaactggccacgttaaaatctgcacagtgcttttgtgtcactgtctattctattagtttcaacatcatgctaaaataggacagcatgttccaaaactgaaactgaaacaggaacggagccttgctgatttagcatgaggagggaattgtaagccttgcacctggacactaaaacttttcaataagatgtatgctaagccgtacctagcaaacttaccaggtccaaagtagagtacaagcagaaagttatttttaaaggatgggcactatccttgagggacttaccctttctaatcagctttgcatggtttgttttgagacagtgtctcactctgttgcccaggctagagtgcagcggcaccatcacagctcacggcagcctctgcctcccgggctcangcaatcccacctcagtttcccaagtagctgggactacaggcacacaccacactcagctaattttagtattttttgtagagacagggtctcgccatgttgcccaggctggtctcaaactcctggattatctccctggccctgcattaaaaaagatgtgcaacaactt

SEQ ID NO: 40929 - DNA, 2162 bp, Homo sapiens
  misc_feature (1996)..(1996): n is a, c, g, or t
gaatggggtaacctggctaaatgagaattaatgaacccacactcataagttttcattgacttagcaccaagtcgtccatcaaatatcatcagatctgagaatgctcttatggatatctgatttttagaggctggcattcatatttttaaaaactgccacctgtgaccacactgcaggccaaacagaatgtacctgctggtcagatgcagcccagaggtcactgaattgcaacctctggactctcggtcagaggcaagcagcccttattccagaactccacagtcccttcacacccttccccagacctacaccaagaccaactaagtggtcaaaaggtggacaaactgagagttgtatcaaggcccttagcctctcaatttgttatcaagtttccctttctgaatctatttaccctgaagtataaatacccaagatgagccttaagagtgcctggtagagcaaacaaagatgcatcttatagggagcaaagtctatgctaacgcagtgtttctcaatcctggctgcacctttgaaccacgggagctttaaaagtgaccactgcaagggccctacccactatggatcccaatttcattggttgggagaggggccaagtttgtttccaacttccccagatgactctaatggctgagagttgcaatcaacaggtaagtgaatatccaggctgtaagatgaagaaagagggggttgtgcccaagcccactgtgcctcataaagcagatgatctctgcagcgctgcgcttctcaaagagtggtcccaggactgcctcagtcagaccacagactcctaagttcctcctcagacttcatggatccaagctctgtgaggtaattctaagcacattaaacttgtagaacagccatctggatttaatattacataatagctataatattctgctattctctaatcttcaatgtcagtttcttaaactgtcaggcctgtctttagatgcccttcaactgtgctggggactatcttgatggcagccagcaaagaaaatcagcaaaaaccccagtggagtttctgggttttacttttgttaaggaaggtgatggtttcttgacatgacaggtatctaggtggaaagggcaaagtgctaatgcaaacacaatggagacactatggaatagctctgcctagggacatgtggaagagcttctaggagacagtgtggacctttccatccctagaggtcttcacaagataaattcctacctccgtcagtattcaaaaggttttagcatcaatactgtctgagaataagacattagacttgagtcagtcccctggcttcaatcccaggatgccaagcagcctctaatggagaccgctggcttaatcgtgctcctttcctggcataacaactcactgcacccatgcctcaccaccacgaagcagtctcctcaccacccaaatgtgccttgggtgacttaaatacagccattagtatgaatggtcccctgtttttattcaacaccacaccagtctttgcttttaccttcggctaatgtggttccagccttttatcctgcactccttcttataatttaaaaaaaaaaaaaactcccctactatctttatgttaatattaacatcaactaggttcttctcaaaggacagccaggcctaactggccacgttaaaatctgcacagtgcttttgtgtcactgtctattctattagtttcaacatcatgctaaaataggacagcatgttccaaaactgaaactgaaacaggaacggagccttgctgatttagcatgaggagggaattgtaagccttgcacctggacactaaaatagagtacaagcagaaagttatttttaaaggatgggcactatccttgagggacttaccctttctaatcagctttgcatggtttgttttgagacagtgtctcactctgttgcccaggctagagtgcagcggcaccatcacagctcacggcagcctctgcctcccgggctcangcaatcccacctcagtttcccaagtagctgggactacaggcacacaccacactcagctaattttagtattttttgtagagacagggtctcgccatgttgcccaggctggtctcaaactcctggattatctccctggccctgcattaaaaaagatgtgcaacaactt

SEQ ID NO: 40930 - DNA, 323 bp, Homo sapiens
acagtgggataattcttttctgtatatagttatatcaccagtgtggtatacagttagggtaacagtgggataattcttttctgtatgtagttatgtcaccaatgtgatatacagttaggttcattgtattccatttgtttcaacctttagggattccttttaaactttaaacactacttttgattgaacagtaactgcagcaaatagtgatttaacttactacagccagaaactgtgccaaatcttgaaaagttaaaaggtgtttagaacattgttcataccattaaatttaaatgggaagatgaaagatacagaatgcttta

SEQ ID NO: 40931 - DNA, 383 bp, Homo sapiens
attttgaaatgaagaaagccataagcaggtgccagatgagtttcctgggcactcagaaggaagagagcctgcagtaggctggaatggccaagtgggaaaatggacagaatttagacaaatgcagtagaggatgagggagagtgtatcatgtggcagagatgatggaagtacaagcattgtagtagttcttaatttgttgatcctaacacccctttgccctcatattttcttagaagacctgagggaacgtttcatgtgcgttatatctatatttatcatattataaatcaaaaatgagaaattaaaaaatatgttcaattgatttaaaataacaaagtgcccattacaagttaaaatacttatttttaggaaaaataactaca

SEQ ID NO: 40932 - DNA, 518 bp, Homo sapiens
gcctgacacctaaaacatgactaggacagaatgcgaggttgattttctggggacagtcgccacccccttccttgccctctctctcctttctgtctctccctggtttccccttctgcgtcttcccacctctcccgtttttgcgtcttcgtgtttctcacgccctgtgtcatggcctcctccgtcttctcccgctctgtcacagtcttccgccgggggctaggggtgcccggcccgcatccctgggcgaccctgagtccccgcaggccgcccgaggccggggtggttccgcatggggtctctgcccgaggcctttctctgccaaggagggagtgtggacgctcggggagcccagaagggcgctgcacccacggggaccggacgtggtgggcggacccctcctcctgcgtccccgacgggacactgcccggggcccacacggcctccgcgcccccggcgggacggacaccccgggccaccgcgcgccccccaccacctacccggcctcgctggattcccgg

SEQ ID NO: 40933 - DNA, 490 bp, Homo sapiens
  misc_feature (323)..(323): n is a, c, g, or t
caacaatgataataaatgattcctggtacaatcatgcatgttgttctcatgtttctctcagtatttgtgatccacaggtagagggtgaccaggtgagtacctggaccggctgtcccatgggtcagagtaaagatcccatttactcatggggttggcattaaatcacctttcactggccatcccccaaatatggttaccgctttaccctttgacttctctgtccctctgtcttcactcctcccatcttcctttcccttatgttcattggactgacacttcctgaggggttactatgtccaaggcaccctgctggggcagggggnagcacaggaataactcccagcccttgtctggcaagggcacttcagccctgtaggggaagcgcagtgcccaggaggagaggccaggaggaggcggaggccagacagggggagtgttcaccaagaagacatggcttcatgggcctggcttttaagaccagttgatgatt

SEQ ID NO: 40934 - DNA, 467 bp, Homo sapiens
ccaggaaaggaaaaggttaactgaggttgaaaaaaaaactttatgtggcacttttaaacaagcaggttggtttggcttgtgtgactatgatggtgcctgattttgagcagagcaatttgtgttgtgacattttaaaatccattctggcacttggtgatgaatgtgttggctggcagctaagaacttgctagaatgcaagtatgcaagtcttcaccatttataatcgacacttcctttccaggaaagagcctttctaatctttgaatcagtggatttatcaatttgcataaaatatgccatcctcaatgaacacatttatcatctaccacttaactttccttctgttaaaaaaaaaaaaaagcagaatcaccttcctgtgagtcagcagctttaaattcagctgtgctgggtgaagctgttaagggtaggaaggagccatcactagaagggggagaagcaggaataaa

SEQ ID NO: 40935 - DNA, 861 bp, Homo sapiens
  misc_feature (23)..(24): n is a, c, g, or t
ggaaaatataattatcagattannggtatcttcgctccatcaacaccaaaagaaatcagcaccaacttcaaacaactgcttactggacattgaagctttatggccagctgccaaaaaaataaatgcaccttaatttttaaattgaattataaagccaaaaatatcctattgctctattcctcttattttggtgtttacatgtgactttataatttccttcacttgaaagattttaactttaaaggaaactttactctgaacgtttaggacaattcatagataatcaaattgattatcatgttttcaatgttaaatattacttcatatgtctttttacaaccttcagaataagaaagccagctatgaaataccaagtcttgactagtagtgccacctagcatcacaaagaaaaagttgttcaactactttgcaaagcattggaaatttatcaaatcatctaatatactatctccttgatccttaatccagaggaaaataagcagacatgatcaattagaagaaatgtacacaaaacctatgtaattttagagatagtatactacatattatgaatgtttgtgttttagtaagatgtagttatgagatgtagcagtaagatataatttctggtttgctgactgatatgctaccggtttttcctacaatttaagaaaacatattgggattcaaatgaataaaaataatgtttgtgtactgaaatattggctatgacctaatttatagaataaaaagtaagtcattcacaaaaaacaaaacaaaaaatgggctcgtcggcctaaacggtggagctctgtagccgccccccttagagagggtcattaatgaccctccccactgctg

SEQ ID NO: 40936 - DNA, 717 bp, Homo sapiens
  misc_feature (23)..(24): n is a, c, g, or t
ggaaaatataattatcagattannggtatcttcgctccatcaacaccaaaagaaatcagcaccaacttcaaacaactgcttactggacattgaagctttatggccagctgccaaaaaaataaatgcaccttaatttttaaattgaattataaagccaaaaatatcctattgctctattcctcttattttggtgtttacatgtgactttataatttccttcacttgaaagattttaactttaaaggaaactttactctgaacgtttaggacaattcatagataatcaaattgattatcatgttttcaatgttaaatattacttcatatgtctttttacaaccttcagaataagaaagccagctatgaaataccaagtcttgactagtagtgccacctagcatcacaaagaaaaagttgttcaactactttgcaaagcattggaaatttatcaaatcatctaatatactatctccttgatccttaatccagaggaaaataagcagacatgatcaattagaagaaatgtacacaaaacctatgtaattttagagatagtatactacatattatgaatgtttgtgttttagtaagatgtagttatgagatgtagcagtaagatataatttctggtttgctgactgatatgctaccggtttttcctacaatttaagaaaacatattgggattcaaatgaataaaaataatgtttgtgtactg

SEQ ID NO: 40937 - DNA, 491 bp, Homo sapiens
ggtgtgagccaccgcggccggcctattgtcttatacacttaattcttttattcccaattcccagttttattctaattcttctccctctgcaggcaaccattctaaaatatttcaagtgtatcttctgttggatgtgttttagcagaatgtgatatctgtgggcctatattttaatatacttgatatattttatgcttttctcactaagcactaggtttttcagatctaatcatattgttaagggcatgtttgtagacaccatgttcacattttaactatgcattttcccagtgacggacaccagattgcccccaacttcccatcctcaggaataaaactgcaacgagcaccctgcgcagtgtgagacccaagtgacaggccacaggagggcactcgctggccatggggcatgcaacatacagctctgaatttgctgctttccagaatagccttagtagcttcacagtcttggtacttggaattctctcact

SEQ ID NO: 40938 - DNA, 404 bp, Homo sapiens
acccatagttctgggatcttctgacctgaaggattccactttcttaaaggtagcagagctaaccaaaccgtaggtatgctttcatgacaaatatgagatgcactggaaaagaacatacctggggccaggcgcagtggcaaagtgctgtaatcccagcactttgggagttcaaggcaggtggatcacaaggtcaggagatcgagaccatcctggctaacacgatgaaaccctgtctctactaaaaatacaaaaaattagctgggcgtggtggcagacacctgtagtcccagctactcgggaggctgaggcaggagaatggcatgaacccggtaggtggcacttgcagtgagccgagattgcaccactgcactccagactgggcaacagagggagactctgtctca

SEQ ID NO: 40939 - DNA, 369 bp, Homo sapiens
gtgctttcctatggcctgcttattcccaagcaatacctatttccaaagaaagttcattttattttagagtctttctgtatttgttatgcagtgtcacatagcggagccagaagtgggaccgaagtgaattcatcttggatgaatcagcgtgtcctggaatctaacgcagtgttgactgagccccccgcagactgcctttccaggagttgcttttctgttctggtgaatctcctcaaatacccagattccctccctttggtcagttcctttttactttatcctggatgtgatttgattataaggctcccttaaacaaaggaccttgcatccctcctgagggtataaaggttgggtttctttctttctttc

SEQ ID NO: 40940 - DNA, 175 bp, Homo sapiens
tgggggtagaaaatgatgttataattctgaaagcaaatctagcacatctaaggatttacctaaggaactaatagggaagatcctaaaatacagtggtataaggtggcaaaaatatattgagtacctgatctttgcacgagctttgttggtgaaaagcaagcttactttaaaaaag

SEQ ID NO: 40941 - DNA, 295 bp, Homo sapiens
cccctcgcgttgcccggatgtgggaggccgcgggcggtggcggcctcgcgcacaatgagcccaagccgagctagcaaagggggagattgcacaacacttagaagcgaagcagactgggggaggggaacgcctcaggccaccatgtgctcgctccctcgaccacccggcggcgtctcccacccctccatgaacaatccacatcccgcccgcccccgtcgcgaagtagcgtcgccctcccatacctcaggccgctcacccccgaaggaaggtggacctgcccatcccgcagtttgcc

SEQ ID NO: 40942 - DNA, 427 bp, Homo sapiens
aaaattaaaggggtttggtgaatccattgctcctgccatcacccagattaaagacctgccctctcatccgcagtcagggattgagtgggcaagcactgtgggctgcagacaccaagctccaccatgattccccctccactctcagaggctccatccagctggcaggctcacagcactgcagcccagcatctgaagtgctctggtttattgctcctgtggtttccatgaatgagcttctgtttcctgctcctctctctttccacccaccctcccagagtggtccatgtcccagtagcagctcattccactttgttagtatgagttgttgccttgaagggtggcttcagtgcatagagaagactatctgtggctccttgccttttaaattactaatcaaaatattcaagtaaataaaatgccaaactta

SEQ ID NO: 40943 - DNA, 638 bp, Homo sapiens
gggggcttggtgaaaatttgctctaggtcccagacttggcaaatgatacaagatttaactcacacagtccggcttccaagcccacactcttaaccactgtactctcagtcagggattgagtgggcaagcactgtgggctgcagacaccaagctccaccatgattccccctccactctcagaggctccatccagctggcaggctcacagcactgcagcccagcatctgaagtggtactgtccctaggctgatgactgtcacatttttagtggggccaaaactttcctccaagattcagatgtgtgtcaccaactagagagcaggcttggaatttaaaaataaagttttcatggaggggcttctatatgcccctttctgcttgctttgactttggccatgtggaagagagatgaggcagcacttccaggggatccttcaatcaacctatgattcttaatacttgaattaaaaggagaatggtcattaaacagaaactgctgctaaaagtgacaagcaacttagcaatacacattaggagcaaagattataatttatgcagcatattttcatatacaggcaaatctgagatagaaggaaaaacaaatggcttggaataaaacaaaatccttaaaatgtgta

SEQ ID NO: 40944 - DNA, 647 bp, Homo sapiens
gggggcttggtgaaaatttgctctaggtcccagacttggcaaatgatacaagatttaactcacacagtccggcttccaagcccacactcttaaccactgtactctaaaattggaattactatcctaggcaaactggaatttattcttcaaaattgttgaagttatctcctcagtgggattcaattagctaaagatgagagattttcagctgggagcagctctggagcagcagatacactgggtactgtccctaggctgatgactgtcacatttttagtggggccaaaactttcctccaagattcagatgtgtgtcaccaactagagagcaggcttggaatttaaaaataaagttttcatggaggggcttctatatgcccctttctgcttgctttgactttggccatgtggaagagagatgaggcagcacttccaggggatccttcaatcaacctatgattcttaatacttgaattaaaaggagaatggtcattaaacagaaactgctgctaaaagtgacaagcaacttagcaatacacattaggagcaaagattataatttatgcagcatattttcatatacaggcaaatctgagatagaaggaaaaacaaatggcttggaataaaacaaaatccttaaaatgtgta

SEQ ID NO: 40945 - DNA, 301 bp, Homo sapiens
catcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaa

SEQ ID NO: 40946 - DNA, 362 bp, Homo sapiens
atatgggcctataaaaaaatttaaaaaataaaattccactattcctggcatattccaaaattttcctcttttgattagagtttttttggacaagtcccatgcggagtctgtcctgaagactctggctgagtgatggatgaaaggagtattctgacacaggtattttgcatgagaacggctgggggagtgccagctttagtgcagccgagaagagagtgcagtcctgataggctggaaccatttgtatttattcagtagagacagaataccaaaggcctgaagccaacacaatttgtgagtaatgaacattgtcgcccccctttgcagggagcagtcttgcatgatttccggagggcataagt

SEQ ID NO: 40947 - DNA, 344 bp, Homo sapiens
atgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgc

SEQ ID NO: 40948 - DNA, 393 bp, Homo sapiens
  misc_feature (389)..(389): n is a, c, g, or t
  misc_feature (392)..(392): n is a, c, g, or t
atgctgttttatataagagacaagcatctgtgggttttggtatttgaagggggtcatggaaccaattctccatagataccaagagacatgactatatttattataaagttagattactccaaaagggttgtttttaaatactgacccagagaaagctaattagactataactaagatctgtttgttcttttctctgtttttgtttttgttttttgttttttttagacggagttttgcttttgtcgcccaggctggagtgccatggcacgatctcggctcactgcaacctctgcctcccaggttcacctgagcctgaagaggtagaggctgtggtgagctgtgatcatgccactgcactctagtctgggcaacagagactctgtttcagnttna

SEQ ID NO: 40949 - DNA, 397 bp, Homo sapiens
gtctaatatgcccatgtcaagaaggcaatatcagaaagaaagaaggcgggctctgtggatttgggatccagcaatccaaaatcccactagaaggcaggatccagcaatttgtggatttccttctgggtggaaaggaaagaaaaccgaccttcactgaccatgcccatttcctttaatgtccccacaaccaattgggggcccagtttatagtgaggagatggaggctcatgaaattgcagttagtgatggggccaggacttgaatccaggttttctgattccagggcagaacctcttcatttggacagaggaagctcagagagggaaaaggactggcccaatgtcacaaagcagattagctacatggctaggattagaatccagttttttatttccaa

SEQ ID NO: 40950 - DNA, 606 bp, Homo sapiens
ccttgcaggcctctcttgacattggggttgggagggtgctggaggtggagggaggtgggaagctcaggcctgcactgttttcctctctgcccggccgatcctgacccctctctgttcctagcagctaccactgtctttgctgatgctgtggttacctttacagcagtggttctcaaagtgtggtctgagcgtcttttgcatcagaatcacctgagataattattaaaactgcaggctctgggccttactctagacctactcagaatcacttggactgggcccaggaatctacactttgtaatgacctccctaatttagtgagccttgtgtgctctaaattttgagaatctcttatttagaaaatttgattttccttttggagtaataataacaagtaatatttgttagaggttaattatgtgatgctactcagtgttttatatgcaataaccgaattattcctcaaaaataacagtgtgaaagagaaactaatattagccttgtttggccagtgggaaaattaaggcaaagagtatttgctctaatgttgattgaagagccaatatgtatgtatgtatttatttatttgtgacaggatctcactct

SEQ ID NO: 40951 - DNA, 395 bp, Homo sapiens
gctgcctacttcgtgaaacctttaatgttcaagtaaactctgttaaatgtattttgcctgtagtttttatttttaacaattcaaaacagaaacttggctcacagttctccttgcagtgcccttcctgagttcaccatccacatggaagaacatccactgtcattctgtgactgccctgtctctactagcctctcctcctacctccatccttttggtgtaaaaagaagtgtcccttcctatgtaaagttctagtggattccaaagtttagaaacctctgtccatcattttgcccacctcttccccctgtcttcagcctgttcatctctcccctccttaccatctattaataaacatgctcaactgtgacatcactcaaaaaacaaaaacaaaacct

SEQ ID NO: 40952 - DNA, 137 bp, Homo sapiens
tcagacctttgttatttgttaaagcactcagcaacccagaactaaacatgcacgccgatgttgatttgagaactaaaggatatctttcaagtccaataaatgtgataaaaataaacaacatcctttcataaatttca

SEQ ID NO: 40953 - DNA, 1948 bp, Homo sapiens
  misc_feature (935)..(935): n is a, c, g, or t
ctgttagtaaagtgcttagaacagtgctgaacttgtagtcaatcctgtgtaagtttttgttagataaaatagaaaactggctgggcacggtgactcatgcctgtaaacccagcactttgggaggccgaggcgggcagatcacgcggtcaggagttcaagaccggcctggccaacatactgaaaccccgtctctaccaaaaatacaaaaaaattagccgggtgtggtggcagatgcctataatcccagctacttgggaggctggggtaggagaattgctagaacccaggaggtggaggttgcagtgagccaagatcatgccattgcactccagcccaggcgacagtacgagactccgtctcaaaaaaaaaaaaaaaaaaaagaaaaccatacattccaaaaatagcgattgagcattagctctgtgctaggggctgggaacaccaaggagaagcacccacccctgtctagatggtgttgatgggatgccagggaagacttggcggagggggtgatgcccacacggtatcctgaaggaggaatgggcctgagccaggcaaagaggagcagggagggtgtggctagcacttcatgcacaggtctagcaagtgcaaaggcctgggggtcagagagagcaggatgcatttgaagagctgtctagcatggctggagcacagcacaggaagagttcatactccacctgtttgtctgtccatgtgtccatccttccatccggcacatgaatagttacatgagttgctgtcatggcccccactgccaggactcttctgtttagcccagaaggccctgtctatctctccagcctccctggctcttgccgctgacggtaccctccacctccagctctatccagttacatgcactcccttgaatacatcttgcttgctcctgcctctgtgcctttgcacctgctgtncactgtgcctggaataacctttcttttgttttgaaccccttttgaaaaataactctccacctgctctgattttgcaagaaatatgcctgccttcatcatcattaagactcaggaaggaagggtcattttgccttattatttccccctccaggaatcatccccctgacccacctgtctgggctgggtttattgctttctcctttgtgtctttgtcacagccctgactatactgtgccacctgtgtctggcctctctgccagactgagaatgcaatgaggacagggactgggtgtggttcattgtcactgctggccagagagacccaggaggtcaccagacctgggtcctgccctcaagaaccacgccctcgagggaaatgatgcacacaggaacagtaaccaggatactgggcagagtagactagtaggcgcctgggtcctctggtcatggccatggggggcccaacgtgaagttcccaaggagcagcagaggggtgttctctgcctgccagggcctgactccagctgtgcaaacagtttttgcaaaatgcatcttggcctccaccactccatttgtcctgcacagtttgctttggcttcaccccagtctcaggcccttcatcccttcccaccggtccccactccttccattggtttcccaggccttgcacctcagactactgggagcactgtctgagccaaaccctagggctcaatgaaaaccagacgtaaggctgggtgcattggctcacgcctgtaatcccagcactttgggaggctgaggcgggccaatcacctgaggtcgggagttcgagaccagcctgactaacatggagaaaccttctctccacgaaaaatacaaaattagccgggtgtggtggcacaagcctgtaatccccgctacttggcaggctgaggcaggagaatcacttgaacccgggaggtggaggttgcagtgagccgagatcgtgccattgcactccagcctaggcaacaagtgcgaaactccatctc

SEQ ID NO: 40954 - DNA, 258 bp, Homo sapiens
cacgtacacatgtattcttttcaaccaaatgtggattgaaaatacagtactctagatccctgaggaatcgccacacactctagatccctgaggaatcttcctcaatggcacatatgcaccatggaatactatgcagccataaaaaatgatgagttcatgtcctttgtagggacgtggatgaagctggaaaccatcattctcagcaaactgtcgcaaggacagaaaaccgaacaccgcatgttctcactcataggtggg

SEQ ID NO: 40955 - DNA, 362 bp, Homo sapiens
ggaggctaccaaatagtgtctctggtttgtaacatttattccagtttaaaaataatacatacaggccagttgctcaagcctgtgttcccagcaatttgggaggccagagtgggaggatcgcttgagctcaggagtttgagaccagcctgggcaacatagtgagaacccatctctaatatatatatatatatatgcatcaaataaaaaaaagagaaggcccaataccaaaatattaatgtagccatattgctatacagagaggttatgggtgatttgtattttctaattttatttctattgtattttccaactatttttcaatgggaaataagcatattcctttggtcttagaaacaagtcaa

SEQ ID NO: 40956 - DNA, 318 bp, Homo sapiens
tcagtataacctagcctacttcttttcagcagagatccatcagtaaagcttggtaggttttccatcacagctaactagtgcactttgttggctctgtagtctcactgaaatagaaccctatgtgggtgtggtcactggtagatggtaagcagggtgctcacacaggtgtttcaagaagggggttccaataggccaggtacggtggcttacacaagtaattccagcactttggaaggccaaggtgggtagatcacctgaggtcaggagtttgagaccagcatggccaacatggcgaaaccccatctctacttaaaatac

SEQ ID NO: 40957 - DNA, 358 bp, Homo sapiens
tccatgtgatcttcctcatggctagcccagggtggtccttgggtaattggacttcttacacggcagctgtcttccctcagagccagtgttttgagagactgaggtggaaatcgcaggccttcttaggccttaacttccgcggttgtgcagtgtcacttctgttgtgttcttttagttccatgaggctggcccaaattcactgtgggaggcgactgctcaaggcagcggtaccaggtcgggtttgtaggttactttgggaagttaactgctacatgcattcattgtaaagctttggggaattagaatctggtcagtcatactgtctttgcttcccctagccccgaacccgcaaaaatgc

SEQ ID NO: 40958 - DNA, 321 bp, Homo sapiens
  misc_feature (23)..(23): n is a, c, g, or t
  misc_feature (114)..(114): n is a, c, g, or t
ttatacaggaggaaactgaggtncccgtgtggttaggtaacttgcttgggtttcccatagaggcagaggtagaatttgaacccagtactgtttagctcatgccctttctggaanactctcttgcctctctatcttttctttttgctgcactccagcctgggcaacagagcaagactctgtctcaaaaaaaaaaaaaaaaaagaaatataatctgcccaacccaacagtcaaatgttagccaccaatgtccttgtgttaccctgctttctgagggccagaagagattttcaaagattatgagcactaaaataacagtaaaaa

SEQ ID NO: 40959 - DNA, 717 bp, Homo sapiens
agcgggggagtctggctggaggccaaacaacacaaaaccagcacacttaacaaaaatataaccaatgacccttgcagagtccacttaactcccctccaccagagcaggtgctggtatccacagctgagagacctgaagatggatcacatcacaggactccttgcagacattctccagtaccagcccagagcctggtaggtctgttgggtggctagaccagtattctaagtgaagtaactcggaaatggaaaaccaaacatcatctgttctcactcatcagtaggagctaagctatgagaacacaaagacctgtccacgctgagtttatagcaactgtcaattacggttcagattttcctaccccagcgtgactttccaaagaggcttctgctcatggatttctgctccaggaagatgcaacaggaaggtcctcacaagatggctgaacagatgcaggtgctgtgcctctggactgcctagcctccagaactgatacatatgcaggatgtgcagctttgttacacagtatgaagcatgtctttaggactttctgtgccatctggtatccatcaaggggagagtcccaaactgcactggaaggcatcttccagatggtggtgggcgctaaagatcagctgtgtgggtgtgagcttcccatgcctgtggagaagcagcaattgaattgctcatctggaatgaagtttcgtggattttttt

SEQ ID NO: 40960 - DNA, 818 bp, Homo sapiens
agcgggggagtctggctggaggccaaacaacacaaaaccagcacacttaacaaaaatataaccaatgacccttgcagagtccacttaactcccctccaccagagcaggtgctggtatccacagctgagagacctgaagatggatcacatcacaggactccttgcagacattctccagtaccagcccagagcctggtaggtctgttgggtggctagaccagtattctaagtgaagtaactcggaaatggaaaaccaaacatcatctgttctcactcatcagtaggagctaagctatgagaacacaaagacctgtccacgctgagtttatagcaactgtcaattacggttcagattttcctaccccagcgtgactttccaaagaggcttctgctcatggatttctgctccaggaagatgcaacaggaaggtcctcacaagatggctgaacagatgcaggtgctgtgcctctggactgcctagcctccagaactgatacatatgcaggatgtgcagctttgttacacagatacttttggctcggtgaatggtgcttatcagttaacagcagaaaccctcctgaaatggaaaatggttcattgtttccatcatgtactctatggaatacaaagctctgaaacctgttggctactggaagtgtacaagaaaaagactctcaagctagaggtggggtagagctggagccagccatgtcaagatctttcgaggacatgaacattttttatgcttattaaaagatgatgtggttttaaaataaatctaaggctgggcgcagtggctcatgcctggaatcccagcag

SEQ ID NO: 40961 - DNA, 844 bp, Homo sapiens
agcgggggagtctggctggaggccaaacaacacaaaaccagcacacttaacaaaaatataaccaatgacccttgcagagtccacttaactcccctccaccagagcaggtgctggtatccacagctgagagacctgaagatggatcacatcacaggactccttgcagacattctccagtaccagcccagagcctggtaggtctgttgggtggctagaccagtattctaagtgaagtaactcggaaatggaaaaccaaacatcatctgttctcactcatcagtaggagctaagctatgagaacacaaagacctgtccacgctgagtttatagcaactgtcaattacggttcagattttcctaccccagcgtgactttccaaagaggcttctgctcatggatttctgctccaggaagatgcaacaggaaggtcctcacaagatggctgaacagatgcaggtgctgtgcctctggactgcctagcctccagaactgaggtgttggaagctgtgaatgtggatgaaagtaccaatatagagagaacagagtgagaatagaagacagcccaagaatctaaagtcatgcacttgcaagggagtcagaggaagagagggaaaatggttcattgtttccatcatgtactctatggaatacaaagctctgaaacctgttggctactggaagtgtacaagaaaaagactctcaagctagaggtggggtagagctggagccagccatgtcaagatctttcgaggacatgaacattttttatgcttattaaaagatgatgtggttttaaaataaatctaaggctgggcgcagtggctcatgcctggaatcccagcag

SEQ ID NO: 40962 - DNA, 485 bp, Homo sapiens
tttttcccatataaacagccttaacttttaatattatatactctctaattttcttatacagttcaataaaaaaatatttaatacagatcttttaaatatttcactggcatttacattgtttcattaggtaacataccaatagtttttcactttctccttaaggatgaattcagtaaatattccaggaactcaataaatataggagtagacagttaagtttgactataatgcataaaatatcacagaacaaactagggaaataggataatagcagaaccattctttctcttaaaacagaataatattttaaataactatttttaaaagtaatttggtcttatttatcaattaccatggaaatgtaggcaatgcagggcacagtggctcatgcctgtaatcccagcaacataacacttgctatgttgaccaccttgggcaacatagcaagactctgtttctacaaaaaaaatttaaaaattacccag

SEQ ID NO: 40963 - DNA, 273 bp, Homo sapiens
  misc_feature (13)..(13): n is a, c, g, or t
ctcgaggcccaanaattcggcacgagtggtgacaagtatcacaaaaacactgctctgcattgggcagtgctagcagggaataccacagtcattagccttcttctggaagctggagctaatgttgatgcccagaatatcaaggcaatccttaggtgtcacatggccctctagtggaagggatgctcagctggaccgaggcaactgcaggatattcccggggagttgttacccaagggattgcttttattcagggcgaatcagcactttcttgga

SEQ ID NO: 40964 - DNA, 4743 bp, Homo sapiens
ggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 40965 - DNA, 4695 bp, Homo sapiens
ggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 40966 - DNA, 1038 bp, Homo sapiens
ggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaaggcaatccttaggtgtcacatggccctctagtggaagggatgctcagctggaccgaggcaactgcaggatattcccggggagttgttacccaagggattgcttttattcagggcgaatcagcactttcttgga

SEQ ID NO: 40967 - DNA, 4689 bp, Homo sapiens
ggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 40968 - DNA, 4639 bp, Homo sapiens
ggacagagggggcgtcacgggggcaggagaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagagatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 40969 - DNA, 363 bp, Homo sapiens
gtctatgtaatttttccctggatgtcttccccttctactcttgtgtggactgcacagtgtagctgtcagctcttccaccctgctgactggactcactggttcctaggtcccttctcttcccttattttcatttatattcctttcttttcctgaaacccatcaactattagctcctagaaggcatatggaaggtaaattttcgtccttgcatgtctaaggataattctatctacttttgttcttgatcaatggtatggttgattgcagaattcaaggtagaaaagtgttttcttttaaaactttgaaggcattctttttttctagcatccaatgttgtgcttgaagttcaataccatttacatt

SEQ ID NO: 40970 - DNA, 355 bp, Homo sapiens
tgagtgaatggttcccaataacaaaaggctggaagaatattgtatttatgtggaaaaaagagaaagaaaagaaaaatgcgctagccaaagatgactagaaacaaactaataccataaaagtcagaggaggatgaaattgaaggcaactgagaagcctggaaacacataaactaatggcaatccttgttttcagacacaatatattcttgagaaatggatggccataacatgaaatcctgactgtccacctgtttagacaataacagaaaccaaagtactacaaagcctcagagtcaaagggggccttaaaagtcatccagtcttaataagtggtgtggggacaggtagatattca

SEQ ID NO: 40971 - DNA, 531 bp, Homo sapiens
gcttgtgagaatgtcatttagagaaatcttaaagtaatttatccataatattaacttagcatgccttctctctgcaatgtacaatgtatcataggacaatgtatgatacagctcagttttgatatatcagcaagttgagtagtagtttttgtttgtttgttttagttgttttaaaagctggtgttgcagattcctatgcttagaaggaccaggcagagaataagccattaagggtgctgggaatgcaatagggagtgatggggagtgtggtaaaggggtcagcaatgcttctgccatgcctatcagggagctggtttccattagctgttggttgacccaggaatctgtacctgtgttgccagatctaaccattttccaggagaggctggaacttcatatttaaaaaatgagaatttgtcaactttaataatttggaagaaaattcaaattaaaccaataccaggcagtgtggtgtaccccacattacagaggaaagtaggggacttgggaggtacatgagtcaatctatag

SEQ ID NO: 40972 - DNA, 605 bp, Homo sapiens
tatttttgtttgtgagagaatgttgatgtatatacactttgaccagtgcaaaatttgttgtttttctttacccaaaacgttttttactgtttttttttcctgatgctattttataactagttttctggtcctcccactagcttggtgttcattaggcatgccaactcctattccttttctaacactctggcttgattggttacctaacaaacattggtggacctggaaattgatcttattaaatattttcaagtacaaaggaatgccatagtcgcaacagtggttttgtagacaaacctgggttcaattcatcactctggcattcacacttagactttggcgcaattactaattgggttgaacctcattaatctgtaaaatggatcttttatctctgagatatttccagatgtgacatagtaagtgccaggaatgttaattttctctactctgtgtatcttggaagagtaaaatgtgttttaatattaaatattctataattggtagtaatttcttttcagttcagaatactttttgtactatttgatgcttaaaatgatagatgcttattcctctctcctcaccatttgccacctaaaaaaaaa

SEQ ID NO: 40973 - DNA, 247 bp, Homo sapiens
cgtgtctcatgtctataattccagcattttgggaggctgaggtgggtgaattgctcgagctctggagtttgagaccagcctgggcaacatggtgaaaccccatctctacaaaacttacaaaacttagcttgttgtggtgacacatccctgtagtcccagctactctgggagctgagcggggaggatttgcttgagtccagggggttgagactgcaggaagccacgattgctccaccgcactccagct

SEQ ID NO: 40974 - DNA, 531 bp, Homo sapiens
tacagtctatggaaccatgagccaattaaaccctttttctttgtaaattacccagtctcaggtgtttctttagagcaacacagactgactaacacaccaagtctttagtaacccatcccgaaggagagtttgttttcctcttatttgctcatggtttcctcacttgttctgctcttgagccaggattaagattgtgagtaggggctgtcaacacagatgcctgggtgggcatccctctgcttatctccagtcctcagtttcctctgtaaaatgggaacagtaagaacagcactagccagtgattgctgtagtgatcagacatagatctcatggcatttgcctgggttccgatcccagcttggccagcagtagaaatgggagcttggatgagatcacccttctctgtgccttgtgatctgcccaccttggcctcccaaagtgctgggattacaggcatgagccaccatgcccggtgattttcttcttaaacagaagctatcaggactgaaagggatcctctagacgacctca

SEQ ID NO: 40975 - DNA, 456 bp, Homo sapiens
tacagtctatggaaccatgagccaattaaaccctttttctttgtaaattacccagtctcaggtgtttctttagagcaacacagactgactaacacaccaagtctttagtaacccatcccgaaggagagtttgttttcctcttatttgctcatggtttcctcacttgttctgctcttgagccaggattaagattgtgagtaggggctgtcaacacagatgcctgggtgggcatccctctgcttatctccagtcctcagtttcctctgtaaaatgggaacagtaagaacagcactagccagtgattgctgtagtgatcagacatagatctcatggcatttgcctgggttccgatcccagcttggccagcagtagaaatgggagcttggatgagatcacccttctctgtgccttgtgtccttaggtgtgtgctctgcataaagctgggagatgagagct

SEQ ID NO: 40976 - DNA, 436 bp, Homo sapiens
tagctgggtgcagtgcctcatggctgtaatcctatctacttggaaaactgaggtggaggaggaagattgcttgagccgtggctgttgaggctgcagtgagccaagattgtgtcactgtgctccagtctggatgacagagtgagatcctgtctcaaaacaaacaaacattcaagttttggccagagatgcagcggctcatgcctgtaatcccatcactttgggaggctgaggtgagcagatcacccgaggtcagaatttcgagaccagtctggccaagatggtgaaaccctgtctctactaaaaatgacaaaaattagcggggcatggtggcgcatgcctgtgatcccagctactcgagaggctgaggcaggagaattgcttgaacctgggtggtggaggttgccgtgagcccagatggtgccacagcactccagcc

SEQ ID NO: 40977 - DNA, 339 bp, Homo sapiens
gaacttaagccaaatctgctgtttccactcagcaaatgtgtggccacaagaggtgcttgacccgcctgcacacagctcctattaagtcttgtccatacaagcttaataataagataatatctttgctttgtatacacagtggagcctcatatgcataccataattgactatgcagggttagagaggccccaagtcaagttatgtcacagccacggcataatcaactatattcattaaaagcacaatcaggccaggctcacacctgtaatccccgcactctgggaggccaaagcaagtggatcacctgaggccagcctggccaacttggtgaaaccctat

SEQ ID NO: 40978 - DNA, 3456 bp, Homo sapiens
  misc_feature (1816)..(1816): n is a, c, g, or t
  misc_feature (2221)..(2221): n is a, c, g, or t
  misc_feature (2494)..(2494): n is a, c, g, or t
cgcgagggaagaaggtggcggctcccactcgcttctccctcgggtcgggtccgagctgccaggccgcatgccactccctgacggggcgcggaccccggggggcgtctgccgggaggcgcgcggcgggggctacaccaaccggaccttcgagtttgacgacggccaatgcgcccccaggcggccctgcgcgggggacggcgcgctcctggacaccgccggcttcaagatgagcgacctggactccgaggtgctgcccttgccgccgcgctaccgcttccgggacctgctgctgggcgacccgtccttccagaacgacgacagggtccaggtggagttctacgtcaacgagaacaccttcaaggagcggctcaagctgttcttcatcaaaaaccaaagatcgagcctgaggatccggctgttcaacttctccctgaagctgctcacctgcctgctctacattgtgcgcgtcctgctcgatgacccggccctgggcatcggatgctggggctgcccaaagcagaactactccttcaatgactcgtcctccgagatcaactgggctcctattctgtgggtggagagaaagatgacactgtgggcgatccaggtcatcgtggccataataagcttcctggagacgatgcttctcatctacctcagctacaaaggcaacatctgggagcagatcttccgcgtgtccttcgtcctggagatgatcaacactctgcccttcatcatcacgatcttctggccgccgctgcggaacctgttcatccccgtctttctgaactgctggctggccaagcacgcgctggaaaacatgattaatgacttccaccgtgccatcctgcggacacagtcagccatgttcaaccaggtcctcatcctcttctgcaccctgctgtgcctcgttttcacggggacctgcggcatccagcacctggagcgggcgggcgagaacctgtccctcctgacctccttctacttctgcatcgtcaccttctccaccgtgggctacggtgacgtcacgcccaagatctggccatcgcagctgctggtggtcatcatgatctgcgtggccctcgtggtgctcccactgcagttcgaggagctcgtctacctctggatggagcggcagaagtcagggggcaactacagccgccaccgtgcgcagacggagaagcacgtggtcctgtgtgtcagctccctcaagatcgaccttctcatggacttcctgaacgagttctacgcccacccccggctccaggactattacgtggtcatcctgtgccccacggagatggatgtccaggtgcgcagagtcctgcagatccctctgtggtcccagcgggtcatctacctccagggctctgcactcaaagaccaggacctcatgcgagccaagatggacaatggggaggcctgcttcatcctcagcagcaggaacgaggtggaccgcacggctgcagaccaccagaccatcctgcgcgcctgggccgtgaaggacttcgcccccaactgccccctctacgtccagatcctcaaacctgaaaacaagtttcacgtcaagtttgctgaccacgtggtgtgtgaggaggagtgcaagtacgccatgctggcgctgaactgcatctgcccggcgacctccaccctcatcaccctgctggtgcacacgtcccgcggccaggagggacaggagtctccggagcagtggcagcgcatgtatgggcgctgctccggcaacgaggtgtaccacatccgcatgggtgacagcaagttcttccgcgagtacgagggcaagagcttcacctacgcngccttccacgcccacaagaagtatggcgtgtgcctcatcgggctgaagcgggaggacaacaagagcatcctgctgaacccggggccccggcacatcctggccgcctctgacacctgcttctacatcaacatcaccaaggaggagaactcggccttcatcttcaagcaggaggagaagcggaagaagagggccttctcggggcaggggctgcacgagggtccggcccgcctgcccgtgcacagcatcatcgcctccatggggacagtggccatggacctgcagggcacagagcaccggcctacgcagagcggcggtgggggcgggggcagcaagctggcactgcccacggagaacggctcgggcagccggcggcccagcatcgcgcccgtcctggaactggccganagctcagccctgctgccctgcgacctgctgagcgaccagtcggaggatgaggtgacgccgtcggacgacgaggggctctccgtggtagagtatgtgaagggctaccctcccaactcgccctacatcggcagctccccaaccctgtgccacctcctgcctgtgaaagcccccttctgctgcctgcggctggacaagggctgcaagcacaacagctatgaagacgccaaggcctacgggttcaagaacaagctgatcatcgtctcggcagagacngccggcaatgggctgtacaacttcatcgtgccactgcgggcctactacagatcccgcaaggagctgaaccccatcgtgctgctgctggacaacaagcccgaccaccacttcctggaagccatctgctgcttccccatggtctactacatggagggctctgtggacaacctggacagcctgctgcagtgtggcatcatctatgcggacaacctggtggtggtggacaaggagagcaccatgagcgccgaggaggactacatggcggacgccaagaccatcgtcaacgtgcagaccatgttccggctcttccccagcctcagcatcaccacggagctcacccacccttccaacatgcgcttcatgcagttccgcgccaaggacagctactctctggctctttccaaactagaaaagagggagcgagagaatggctccaacctggccttcatgttccgcctgccgttcgccgccggccgcgtcttcagcatcagcatgttggacacactgctctaccagtccttcgtgaaggactacatgatcaccatcacccggctgctgctgggcctggacaccacgccgggctcggggtacctctgtgccatgaaaatcaccgagggcgacctgtggatccgcacgtacggccgcctcttccagaagctctgctcctccagcgccgagatccccattggcatctaccggacagagagccacgtcttctccacctcggagccccacgacctcagagcccagtcccagatctcggtgaacgtggaggactgtgaggacacacgggaagtgaaggggccctggggctcccgcgctggcaccggaggcagctcccagggccgccacacgggcggcggtgaccccgcagagcacccactgctacggcgcaagagcctgcagtgggcccggaggctgagccgcaaggcgcccaagcaggcaggccgggcggcggccgc

SEQ ID NO: 40979 - DNA, 3630 bp, Homo sapiens
gattcctcgccacattaccattagtttctattccttttacatccccaatgtctctcatatccgttgtcttttcttttggcctcccttttagagcctgggacagggctttgagaatgggggaagacgaaggctctggtattgttacccgcctttgcactgctggaagataggacagcatatttttcctaaaaggtgttgccttcttgtgtttgaggtggtttccccgggagaacttcatttcttctgggcataggggaattcgtctttttgtggtcgaggttcagaggtccctagcactcactcgtgtgcttgtgatttgctagacttcgggacccacaacctttaagcagcagaggagcacgaggatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40980 - DNA, 3433 bp, Homo sapiens
aggcggagccgagcccacatccgggagaggagagcggaagtggcgttggtctggccggagcccttgggtgaaattgttaggcgtggagagggagtgatgtcttccagactcggtgctgtacccgccacttcgggacccacaacctttaagcagcagaggagcacgaggatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40981 - DNA, 3098 bp, Homo sapiens
gtgtcatcgatgccaccgtgacccatctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40982 - DNA, 2308 bp, Homo sapiens
gcaaaatttatgctcttagttacgatgccgtcatggaataaaaatctcctatggctcagtgtgttacatctcatgatgagatttatactcaggagatataagagtgggatgatgctaagtaaacagactttgtagatcatttattaaagtccctagaattacgccttacaaaatatgtgcttgtaatagctgctctgtgttggatttctccatcttaaaatatagaatcctgaggtatggttccatatctgtttccttcttactgtgttctgccctaatcatgccttttttccattcttcctccacctttctttatgttcttcactatattttcgactggatgacatttctattttgcctctctaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40983 - DNA, 3496 bp, Homo sapiens
aggcggagccgagcccacatccgggagaggagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaagatgtttccagtgttctttgacgccgacctgctgcatgactccttgacactgtatgggggtaagaagatggctagagatgggggtgagtttgaaataaattccacatgcagttgtctcagta

SEQ ID NO: 40984 - DNA, 1026 bp, Homo sapiens
tcagcgctaaccctatgcgtgtacaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40985 - DNA, 1755 bp, Homo sapiens
  misc_feature (1739)..(1739): n is a, c, g, or t
  misc_feature (1747)..(1747): n is a, c, g, or t
  misc_feature (1753)..(1753): n is a, c, g, or t
  misc_feature (1755)..(1755): n is a, c, g, or t
aggcggagccgagcccacatccgggagaggagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataacgctggggagttcnaaaaaaanaaaagntn

SEQ ID NO: 40986 - DNA, 1777 bp, Homo sapiens
aggcggagccgagcccacatccgggagaggagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggtgaggtttttgtaatcctgtgggcctgatatgtaagccacaagagaggtagactttgtccctattgttatggactaaggctgtcaaggaaagtatctctaaagtggttaccagagccattagagttaaaatattctctaaacttagatatataattgtatttttctgtgaaagtatttgaagtcactgtgaggggtgggcggggtggcttatgcctctaatcccagcactttgggaggccaaggcaggaggatcacttgaacccaggagtttgaggctgcagtgagctggttgcgctactgcactccagcctaggcaacagagatcctgactcaaaaaaaaaaa

SEQ ID NO: 40987 - DNA, 411 bp, Homo sapiens
acaaatgtcttctatgtcagaaagaatttgtgtcagagagtggtgtcaagtatcacatcaactccgtccatgctgaggtgaggtttttgtaatcctgtgggcctgatatgtaagccacaagagaggtagactttgtccctattgttatggactaaggctgtcaaggaaagtatctctaaagtggttaccagagccattagagttaaaatattctctaaacttagatatataattgtatttttctgtgaaagtatttgaagtcactgtgaggggtgggcggggtggcttatgcctctaatcccagcactttgggaggccaaggcaggaggatcacttgaacccaggagtttgaggctgcagtgagctggttgcgctactgcactccagcctaggcaacagagatcctgactc

SEQ ID NO: 40988 - DNA, 621 bp, Homo sapiens
attctggattttgaaggcactttttgcgacagtagatcatagtgggaagaattgtacattggtgcctctggtgaattttgggcatttgatcattttgggggaggaaccaagacaacctggaagtgaagtgaaaggaacataggaaggtagaaagatgtggcatattacctgagaaaaagtaggagactttcaggttgtgttgaagtagggtgggtgattggaacagaattgcactaggatggatttatgttgataatcatccatccaagctggttttcctaaatctattactatattggatctttttccttcttatctttgctgaagtagaattccctcttttcatctctaacaatccctacacatagcccagttatgttgctgaatttaccagtaattcttttttgtttctctcttggaaatagggaaactttgtggctggaaaatacaaatgtcttctatgtcagaaagaatttgtgtcagagagtggtgtcaagtatcacatcaactccgtccatgctgaggtgaggtttttgtaatcctgtgggcctgatatgtaagccacaagagaggtagactttgtccctattgttatggactaaggctgtcaaggaaagtatc

SEQ ID NO: 40989 - DNA, 3374 bp, Homo sapiens
aggcggagccgagcccacatccgggagaggagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40990 - DNA, 3402 bp, Homo sapiens
  misc_feature (1)..(1): n is a, c, g, or t
nccaggctggtaccgcccggatgtagggcatcttgggtgaaatcgtcgaggcgtggagagggagtgatgtcttccataactcggtgctgtagggcgccacttcgggacccacagcctttaagcagcagaggagcacgaggatcgtgggagctaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40991 - DNA, 3187 bp, Homo sapiens
aggcggagccgagcccacatccgggagaggagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaa

SEQ ID NO: 40992 - DNA, 3014 bp, Homo sapiens
aggcggagccgagcccacatccgggagaggagagcggaagtggcgttggtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattggttagagcagctttgttgtcgtgtttctggattctcttccccattttgcgtaaatattgtacacgcatagggtacaggctcgcttcgtaa

SEQ ID NO: 40993 - DNA, 482 bp, Homo sapiens
aacagcgttgcatgcaacagagaaatattttgtgacaggaagagttaattgatatatcagacttcattgttgtcttcttttaagaaattgccctaaccaccccagccttcagcaaccaccaccctgatcagtcagcagccatcaacaaggaggcaagaccctccaccagcaaaaagattacagcttgctgaaggttcagatgattgttagcattttttagtatgaagtacttttaaattaaggtggtttttttagacataatgctattgcagacttaatagactatggtatagtgtaaacataacttttatatgcactggaaaaccaaaaaatttgtgtgacttgctttactgcagtatttgctttattgtggtgatctggaaccaaacttgcaatatctctgaggtgtgcctgtaattttatttccagacttcatcttatcaaactacaatgttctgttcagtattaaatgtttacagcca

SEQ ID NO: 40994 - DNA, 1875 bp, Homo sapiens
agttcggttttgctttcactgtgacaaagcagcatcaaattcaatgcgatgtctcacaatagctgcgctctccctcttccaagcacagagattctctctctacgccacaaagccactgccatgggatggggacaggtggcatcagcaactcaagactgtcttccctaccctcttcattgcctctttcaacagtatgaagttaaaatcaggactacccaggcagggggagctgcaaagaccttggtttctctggcccttccaacagcaagtatcgccaggagcagctccctaatctacatactacagatctatccacaagaagacagatggaaccactcttttcttctgaattctagaaccttaaggaagttaacctgagtggctcagcttggatcaagtgcccatcctggtccaaacaactgtagcagcacatctgtgtatttgtgtatcttgttcctccataatcttgcagtccggggaaagtgtgcagatggatgggtccctgaaaagcaagagttgtttagacaacgctagaggtgttcagttctgggagacaagagttgggccaggttgataactagcctaagagagtcggaatcagatgaataagaactagatcttgggtgacaacctagatcaagagtcttgaggttcagtcatttcaaaaagctcaagtctcattgcttcttggccttctggctaagatcatgtgcagtatctgttcttaccagtttaatatctgatacatcctctatctgaggataatataataaatagatttttggagcaaggagatggaataggagcttgctctgtccactctacacattggcctggattgcagtacctccaggaatggtgcaccctctctaccacccccaaaaagcccaagtctcaagaggtagtctggaaaaaagtgtttttggatttacctacatttttttttccaagatggagtctcgctctgtcacccaggctggagtgcagtggcgccatcttggctcactgtaacctctgcctccaggattcaagcagttctcctgcctcagtctcccaagtagctgggattacaggtgtgtgccaaccatgctcagctaatttttctatttttagtagagacagggtttcaccatgttggccaggcaggtctcaaagtcctgacctcaggtgatctgcctgccttggcctcccgaagtgctaagattacaggcgtgagccactgcgcccggcctaatttttgtaattttagtagagacgagttttcaccatgttgaccaggctggtctcgaactcctgacctcaggtgatccacccccgccctcggcctcccaaagtgctggcactacaggcatgagccaccgctcctggccgggtttgcctacattttggagatgctgcacaccatgtccctcttttcaagagtcacgtaagtatttacatatggaagaccctgagaaggcacctgggaaaaaacctgtttaactgtaaatataataatgtatgtatttgtatgtggagctcttcttttagtggattatctataaaccgtccactgttcccaatgcatactttggagacagacctacactaccagttttcacctgctagttatttttataagggttgggatggtccatgagtgaacagtcttgatttaaagcagtgtttcccaaacctcatttatttgcctatagccttcctggagtttgtcttatatgtccgctctgtgcactattcctatatgtttttatgtaaatcaatcacttttttaaaaagcctcatcccagttatatccttaaaacaatggttattttttctcatacacatcgaaatacatatctattagaattaaaatgcttgtccatgcactatcaa

SEQ ID NO: 40995 - DNA, 527 bp, Homo sapiens
gggtagttttgtgagactcagttcccaagtttaactttttcctttggcatagtaaatttggagtcctgagattttattttcctttcacattaccaaagtaatacatagtaattatagaaagcacacgtaggcagaaaaggagaaaatattatttatcatcatacctttgagagagaagctaaccactcttaacattttgatgttttaatctttataagtgtctgtgatttttttttcaaaagtgagatacgtattttcattatctgctttttttcactgagcagtatgttttcccatgttcttaattgctaatggctgcaaagtattccatttatggatgtatagtttaaccaactcaaataaatgttaatggattaagatattacttatcattacattttaaaggttgagagtaaaattgcctgagaacctgaggagacaaggtctttactggttttcttttttctcttaatattttgctatgttactgagttaataaagcatttaagattaaagtgagaagaatg

SEQ ID NO: 40996 - DNA, 618 bp, Homo sapiens
ttcgtctaaaaaaaaaaaaaagactgtgtaagttacttaactcctctgagcttgtcatcttatctgcaaaatgggatcactagcgtgtatctcgctgagcggtacagatgaactatgtaaagcatttggcccaatgcctggcactgctaagcatgcaataaatggaagttactatcataatgtgtaacacatataattatgacaattatatttccaagatattctgggatctttacagtttcataattttgctctttttactatacaacactccttttattgaaacaaatacagattttggagtcagacagacctagtctggatttgaattccagctctccttcttaccagcctggggccatggagaatgttgtccatttccctgagcctcagtgttcttctctgtaaaatgtggatgatacctgactcccaggcattttgccaggattacatgggattcctacacagtgcaatgtctagtgataatataaatactaaaagcaacttgttaaatgtataaataaatgtgatttatttttgctcctttacatacagtatcatggatataatttgtagatgtgtgtactgtgaatacaatggccacttctcttgctccca

SEQ ID NO: 40997 - DNA, 1435 bp, Homo sapiens
  misc_feature (11)..(11): n is a, c, g, or t
agagaagcgancaaaacatagcgccaggtacgaggctgggtgtggccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 40998 - DNA, 1005 bp, Homo sapiens
  misc_feature (2)..(2): n is a, c, g, or t
  misc_feature (12)..(12): n is a, c, g, or t
  misc_feature (14)..(14): n is a, c, g, or t
tnggctagtagngncgcgtgtgaatcggccgaggcttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatggtcctgggcgggggtcaggaagcatggttgtaaccaaactccacaggatggcagttgaggcaggtctccattggcttgaaaaattgggaagtcagggccttggcctataaggtgctcatcggggaacaacggcgacatgtacgagcaagccacatgagggaggaaacgtcgggggaagaccataaggccgcaaaccaaccaaagcgaccagaaaagaacc

SEQ ID NO: 40999 - DNA, 491 bp, Homo sapiens
agctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41000 - DNA, 498 bp, Homo sapiens
aagtcagttcaggtcacattgggccaggacttgaatatacttcttttgattccaaatctcatgttcttttcacagttctgttctccctcttatgtttacataaagataacaatttggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41001 - DNA, 309 bp, Homo sapiens
ttgcccaggctggagtgcagtggcgccatctcggctcactgcgacctccacctccgcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41002 - DNA, 438 bp, Homo sapiens
  misc_feature (100)..(100): n is a, c, g, or t
aaaacttttggtaaagttcaacccttacccccaacagaataactttgtaagaagtgagccgtggaggggcagaaaggcatcacaccctttcctcactcantataaggagcacagcccaacactcctgtaacaaaagacaggttaacaaaagaaaagcacaacaagcttatttaatcagagttctttattttgttgtattttatttttttgaggtggagtctcactctgttgcccaggctggattgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41003 - DNA, 1447 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41004 - DNA, 1588 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagatacacaccacacaaagtacaacacacacacacaccaacacaaactccggggcatatatcgcgggcgccaacaagatgtttataacggcgcttgcaaagggtttcgcacccttttgtcaaaggggaaacgcggcccaatagaa

SEQ ID NO: 41005 - DNA, 1635 bp, Homo sapiens
agaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41006 - DNA, 1650 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaactttatctaaaaaaaaaaaagaaaaaaaattccatattattcttagtggtgagaacctttgaaatttactcttagcaattttgaaatatacaatacactattattaactgtagtcatcatgctgtacagtatatctcaaaaacttattcctcctgtctgaatgaaactttttaccctttgactagcatctccccattcccttcactccgtctcaaaaaaaaaaaagaagaaggtggatctccaaccaggccagagaagattctcacagaaggttttgaactctaagaaataaattggtttggtaataaatggcttctggtcagat

SEQ ID NO: 41007 - DNA, 1306 bp, Homo sapiens
  misc_feature (1259)..(1259): n is a, c, g, or t
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacaggggggnggtgaaggactgaatggtccctcctccattggcacaaagaattttgg

SEQ ID NO: 41008 - DNA, 1061 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccagttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41009 - DNA, 1728 bp, Homo sapiens
agaaggatgagctaaaaaagtccctgtacgccatcttctcccagtttggccagatcctggatatcctggtatcacggagcctgaagatgaggggccaggcctttgtcatcttcaaggaggtcagcagcgccaccaacgccctgcgctccatgcagggtttccctttctatgacaaacctatgcgtatccagtatgccaagaccgactcagatatcattcacgttgcggccttcctcgcgtcacagccgggatggtgagtttcagagttaggggtattgcagtgggggtcctgggctgaggctggggcccaattccgagcactgacgttactgtcttgtccccacagaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41010 - DNA, 1445 bp, Homo sapiens
aaaattaggctaggtacgaggcctgggtaaaatttggccgaggctcgcgtacagcttgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41011 - DNA, 1405 bp, Homo sapiens
ccagcagccggtttaatcggacgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41012 - DNA, 1437 bp, Homo sapiens
  misc_feature (16)..(16): n is a, c, g, or t
  misc_feature (23)..(24): n is a, c, g, or t
catgttggttcgcccnggagtanngatatcgtcgatccacgcgctccgcgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41013 - DNA, 1373 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41014 - DNA, 1007 bp, Homo sapiens
  misc_feature (849)..(849): n is a, c, g, or t
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccattgtggtcctggcggggccggaagccatggtgttcccaactccacaggttgcagttgangccggtctccatgccttgagaagcgttgggagccggccttgggcctcacggggcccccctggggagcccgccgcgggaaaggggcgttctttcgcccgttcatgttgcaaaggccccggggcggccccctgggcgcggggaccggcctccaaggggcg

SEQ ID NO: 41015 - DNA, 1413 bp, Homo sapiens
tacaagcccggggactgaccaagccagaatccataactgctagggacaccaatgacgacggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41016 - DNA, 1500 bp, Homo sapiens
  misc_feature (81)..(81): n is a, c, g, or t
cagaaactttcttgaccatcctgttctggcgctgcgggcccaggtatggatgaagctgaacacttgcgtgtcattgaggcnctgtgttaccgtatgccaatatcactgcgatcattgaactattgccgtggattgctcacctacattacatatataacttgctgcggcgagggaaccgtaatcggttctgtgatcatgagtcccatcatgggagattgctggaagtacgattgactggcatctattgaagcagcgtaatcgaagcgagctcgagatctgagattactgccctcggactggggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41017 - DNA, 1401 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcattctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41018 - DNA, 1282 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgcttttctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41019 - DNA, 1169 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41020 - DNA, 950 bp, Homo sapiens
ctggctggtacgcctcgagtatgggatatcgtcgaccacgccgtcggcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41021 - DNA, 1015 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggacccttctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41022 - DNA, 1198 bp, Homo sapiens
  misc_feature (16)..(16): n is a, c, g, or t
  misc_feature (23)..(24): n is a, c, g, or t
catgttggttcgcccnggagtanngatatcgtcgatccacgcgctccgcgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgcttttctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41023 - DNA, 719 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagaggtagggtaccagtgaagcagctgacctaagcctgggttg

SEQ ID NO: 41024 - DNA, 442 bp, Homo sapiens
gttttgaactctaagaaataaattggtttggtaataaatggcttctgtgagaatcttctggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41025 - DNA, 602 bp, Homo sapiens
  misc_feature (1)..(1): n is a, c, g, or t
ngaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggcactgcccctccccacgtgactgtcgtgcgctgacgccagggccgcctgtccgcgtttgtttggccggttttgcggaggtttctatgcggcaatgctgaattatccgttagattttcaccccagcttttttgtttgtttttgtttttgagatggagtctcgctctgtcgcctaggctggagcgcagtggcgtgatctctgttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41026 - DNA, 407 bp, Homo sapiens
tgggttgtgggcgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgtcagaggaacagtgatgccaagggagggacaaagacacaaggggtaatgatgacgtaagagttgcattagcgcgatttaagaagagcgatggggacagtagccatgcgaaggtgacttgggggtatgatgagggtttaaagagaaatgaggattttataaaggagaaatggcaacaaagcgatg

SEQ ID NO: 41027 - DNA, 828 bp, Homo sapiens
gacagagtaagactccatctcaaaataaataaataataataacaatttgcatttggggagtgccacctccaaagtgttttggaagaagatagaaagtgaattaattgtgtcccttttcctccagggttcttccatttggcctttgaagaagagtttggaagagtcaagggtcactttggacctatcaacagtgttgccttccatcctgatggcaagaggtagggtaccagtgaagcagctgacctaagcctgggttgggtctctgcctttcccagagtaagcacctgactggtgcctggctatctttttccagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagatattttgtggtgtctgtttcatcattt

SEQ ID NO: 41028 - DNA, 977 bp, Homo sapiens
  misc_feature (2)..(2): n is a, c, g, or t
  misc_feature (12)..(12): n is a, c, g, or t
  misc_feature (14)..(14): n is a, c, g, or t
  misc_feature (819)..(819): n is a, c, g, or t
tnggctagtagngncgcgtgtgaatcggccgagggaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccattgtggtcctggcggggccggaagccatggtgttcccaactccacaggttgcagttgangccggtctccatgccttgagaagcgttgggagccggccttgggcctcacggggcccccctggggagcccgccgcgggaaaggggcgttctttcgcccgttcatgttgcaaaggccccggggcggccccctgggcgcggggaccggcctccaaggggcg

SEQ ID NO: 41029 - DNA, 1448 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagata

SEQ ID NO: 41030 - DNA, 1908 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagattaaaaaaaaacaaaaaaaaaaaaaaaaaaaaaaaaaaaaaaaaaacaaaaacaaaaaaaaaacaaaaaaaaaacataaaacaacacacaaacaacaaaatcacaaacacacaacccataaccaaaaaccactacaaaaaaaaacaaaacaaaacaaaaacaaacaccacacagtccaccacataccatccgcatcggcctcctgacgcgccacgcaacgaaagcaacgcactccacgcagcgtgcgacgctacttgaaccacatgcgacgcagtcctagtacttcatagtagaacgcataccgatagaagtagcgacgagggagacaacagcctccctaacacatgacagcaacaacaggacaagcgaaccacacacacgcgtcccgaacgccaagagagatgcaatacaccatccatcacattatgtagaaagaccgaatcacgcagagaccgaccctcc

SEQ ID NO: 41031 - DNA, 1101 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggctggtctcaaacttctgactcaagtgatctgcccaccttggctcccaaagtgctgggattacaggt

SEQ ID NO: 41032 - DNA, 1432 bp, Homo sapiens
ggacgcgtgggtcgacccacgcgtcgcttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41033 - DNA, 1435 bp, Homo sapiens
  misc_feature (22)..(22): n is a, c, g, or t
  misc_feature (35)..(35): n is a, c, g, or t
tccacctaggctaggtacgagnctggggttagctnctcgcgtacagcgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41034 - DNA, 1440 bp, Homo sapiens
  misc_feature (2)..(2): n is a, c, g, or t
  misc_feature (12)..(12): n is a, c, g, or t
  misc_feature (14)..(14): n is a, c, g, or t
tnggctagtagngncgcgtgtgaatcggccgaggcttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41035 - DNA, 1423 bp, Homo sapiens
tgggttgtgggcgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41036 - DNA, 1012 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatggtcctgggcgggggtcaggaagcatggttgtaaccaaactccacaggatggcagttgaggcaggtctccattggcttgaaaaattgggaagtcagggccttggcctataaggtgctcatcggggaacaacggcgacatgtacgagcaagccacatgagggaggaaacgtcgggggaagaccataaggccgcaaaccaaccaaagcgaccagaaaagaacc

SEQ ID NO: 41037 - DNA, 1327 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacgttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41038 - DNA, 1323 bp, Homo sapiens
gcgactctagaggactccctaagagaccgtgttgatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41039 - DNA, 1417 bp, Homo sapiens
agtgagctcgaaaccttttccggtcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41040 - DNA, 1260 bp, Homo sapiens
ctcgtgcgctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacagacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41041 - DNA, 1145 bp, Homo sapiens
tgggttgtgggcgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41042 - DNA, 1071 bp, Homo sapiens
tgggttgtgggcgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41043 - DNA, 874 bp, Homo sapiens
ctcgtgcgctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacagacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccagttgaacccaggaggcagaggttgcagtgagctgagatcacgtcattgcactccatcctgagccacaagagcaaaactccgtctcaaaaaaaaaaaagaagaaggtggatctccaaccaggccagagaagattctcacagaaggttttgaactctaagaaataaattggtttggtaataaatggcttctggtcagat

SEQ ID NO: 41044 - DNA, 396 bp, Homo sapiens
aggccaaggcgggtggatcatgaggtcaggagttcaagacccacctggccaagatggtgaaaccctgcctctactaaaaacacaaaaattagccaggtgtggtggcatgcatctataatcccagatactcgggtggctgaggcaggagaatcgcttgaacctgggaggcggaggttgcagtgagctgagatcacaccactgcactctagcctaggtgacagagcgagactctgtctcaaaaaaaaaaaaaaaaaaaaaaagagcctgggccagacacagtggcccacgcctgtaattacagaacttttggggatgaaggagggaggattacttgaactcagaagtttgagaccagcctggggaaaataatgaaatcccatctcaacaaaaaattaa

SEQ ID NO: 41045 - DNA, 2769 bp, Homo sapiens
gagcgagagagcccctttagcaagaaaacatcaagagtttttgagtgtggtgtgtggttcccttcgtccccatcagtcgcttcaatatttcaaaatggatccggttctgtggcgggtgcgagagtgaggctgtgggggacctccaggccgaacctccgcgaagcctcgcggcttctgcgtgccctggccccgggaggataaggatttcccttccctcctacttgcgcgcggagccgagctcttgttgagctatggagtcgccaacaaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaattccaaagccgagaagtcatcaggagaacagcaacagaatggtgacttcaaagatggtaaaaataagacagacaagaaggatcactctaacatcggaaatgattcaaagaaaacagatgattcacaagagtaaaaaagacctcatagacaataaaagaggctgccagtgtcttgcatcattctagctgagcttcttcattctccttcttctccttcttccacaaagacccatatctggagaaggtgtacaactttcaaacacaagccccccaccccctgacccttggccttccctcacaccatctccttccaggggatgaatctttgggggttggtttgaggtcttagaactctgggggatattcccctgagcaaaacaaacaacgtgagatttttactcaaacagaaacaaaacatgaaggggcatcctcaaaatcctttgctaatgacctggctttcaaggcatctgtctggcctgatgagaatggacatcctggatatgctgggagaggcctgaaaaaagccacacacacagtaattgccattttatgactgtcaatgccgttactttaaatgttgtcatttttgcactggctactgatgatacagccatgctgacattcatcaccgcaaagatgatgattccagtctctggttcctttcctgagtcaggaacatttgttttctccaatttcctttcagacttaaaattgttcttatgctttttttcccacttctgtaataca

SEQ ID NO: 41046 - DNA, 807 bp, Homo sapiens
gagcgagagagcccctttagcaagaaaacatcaagagtttttgagtgtggtgtgtggttcccttcgtccccatcagtcgcttcaatatttcaaaatggatccggttctgtggcgggtgcgagagtgaggctgtgggggacctccaggccgaacctccgcgaagcctcgcggcttctgcgtgccctggccccgggaggataaggatttcccttccctcctacttgcgcgcggagccgagctcttgttgaggtgagggttccggaagcccacgcagctccgcaggtcggtggtggccgcggctgccctgcgggggtgagtgtgcccggccggggtcggagcccagcgtgtgcccggcagacggcggtgcccgcgcgcccctccctccgcgcccgcggtgacagcccagacaccagcccgggcgctgacagacgacttttctcacttgtcagttttctcgcttgtcagcagagctgctgctatggagtcgccaacaaaggagattgaagaatttgagagcaactctctgaaatacctgcaaccggaacagatcgagaaaatctggcttcggctccgcgggctggctgtgtctaaatgggagaagattgaagggggaaactttacaatatctgaagctaagaatatatctatgaacgaggggcgtgtcaggaaggaggaaatataagaaaacgtcccagaggtaagaacgtctttctgagctgcaactggttgattcatttgtggcccagctcttcacaagtctggctcatggtggactggaactgtaataaacaggcttttggttctttc

SEQ ID NO: 41047 - DNA, 3407 bp, Homo sapiens
  misc_feature (2545)..(2545): n is a, c, g, or t
  misc_feature (2963)..(2963): n is a, c, g, or t
agcggggcggctcccgctttgctcagccgccgcttttctctcccttctcactttctctcctccccacccagccctccttttcacctccaaaccctttagctgcgcgctgatcgcttctgtggctttgtttggggtagggggagaatacgaatagacccgaggtgctttctcttggagctggagtccaatcccaatccctatctctatccctatccctgtgcttatccctgggcattagcccgggaccatggctggttcccgcagctgcatccggagcgcacctggggccatggtttgccgcgatcggagtccgctctaagtcggagtctgggggcgcagaagggggagcgcgccgagaaagtgcccggcaaacgcgcgccgcgcatggctgggcatcgcgagctgggcgaggagacggggaggggacagcccaaactatctcagcttcaccgccagtggtcacctacctgcagctatggagtcgccaacaaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaattccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctngatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaaaaaaaataaaattcctctcattgccacttttttcaatctctaaaagttanttgcccccaaaagaatattggtttaataatcatcatatttaagaaatgcactgataaaaacatattttccaattttaaatacacctatttaaaatgtaaatacacttatttaaaattcaagtaaatatgtaactatcaaagtaaatgtattcaaaacagaagttgtgcttctgaatgtaaaaatattaaaaggaagagaagacggatgaattgttgtattcatggacatttcagaattcatgcttataaagcaaatccaagttaaaaaacaaaaaaagatttttgtgcctcatgaagattgtgcctcatgcccaataacctcatgtactttgaaggatgtgaaggtttgcaagagatgcatttggcttcattttcctctaatcttttacttctacccacagtagatgatacaaaaaatcttgccttaaagactgcaggtttaag

SEQ ID NO: 41048 - DNA, 3143 bp, Homo sapiens
  misc_feature (2281)..(2281): n is a, c, g, or t
  misc_feature (2699)..(2699): n is a, c, g, or t
tgctgtgggaaaccctgggctttggagtcacacgcagatttatcatgcccattagctccaagaggcagatcctattgtttccaagtcacacatgggaagactgaggctccaggaggttgcaaatgaagctggagacaagaatgccagaccactggcccgcttctctcggtctaagtcacagaactgtctgtggaactccctcatcgatgggctcacagggaatgtcaaggagaagccaaggccaacaattgtccatgaccctcgacccccagaggagatcctagctgatgaattgccacagctggatagctcagaagtcttggtgaagacatccttcagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaattccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctngatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaaaaaaaataaaattcctctcattgccacttttttcaatctctaaaagttanttgcccccaaaagaatattggtttaataatcatcatatttaagaaatgcactgataaaaacatattttccaattttaaatacacctatttaaaatgtaaatacacttatttaaaattcaagtaaatatgtaactatcaaagtaaatgtattcaaaacagaagttgtgcttctgaatgtaaaaatattaaaaggaagagaagacggatgaattgttgtattcatggacatttcagaattcatgcttataaagcaaatccaagttaaaaaacaaaaaaagatttttgtgcctcatgaagattgtgcctcatgcccaataacctcatgtactttgaaggatgtgaaggtttgcaagagatgcatttggcttcattttcctctaatcttttacttctacccacagtagatgatacaaaaaatcttgccttaaagactgcaggtttaag

SEQ ID NO: 41049 - DNA, 457 bp, Homo sapiens
aaaaaagtggtggtgcgttctagcctgttagaattacccaagtaaatcacaactgtttaacattctgaattttgcttggctttctgttcaggtctgatccagctattctgtataatgacagatctgtactggagaatcaccatttaagtgcagcttatcgccttctgcaagatgacgaggaaatgaatattttgattaacctctcaaaggatgactggaggtaaggatgagaaaagagagagatttgtaggccagggaaggaactttgaagttggatgaagtatgctgtttttgagaaaagaacaccttgcttaaaatgttgattcgtgttgctttctctctctttctttctctcactctcaccctctctttgtgtatgtatgtatgtcttatttctcttttttctttatacagatattcaaatatttataaataaaggctatggaatgttatgatt

SEQ ID NO: 41050 - DNA, 384 bp, Homo sapiens
gccctctgtgaaatgttttggcaggtcgtggtggctctctgtctaccctgtccacagctggaactgtgaccctcaaggagaagagaatgaagctcagagggacagtgcagatgacagcatgtcaccctttgctttttatggtgtcactgatacattgctaatgactgccatggttattttattcttctacaactcgtcctcctttcctgctcctatttcttaccaaaactagaacttggccctccctgaaattactttctgcaaggggcttgcctccaaattgttcatcccagagaaaatgttgactctttaattttgttttaactgattaatacgtgatatccttaagaaaaaaattagaaactgaagttaaggaagaatgaa

SEQ ID NO: 41051 - DNA, 322 bp, Homo sapiens
ccattcataactttcagcatttaactatgagcatttcccttttatagagatttttttctatccattataaggattatagacttttatgatctaataagaattgaactgaaaaagaatgcttaaaaagctacttatagcagccaaatatttattattaaaatgggatattagagcaagatttgaaagaagtaaaattaaaccattacaataagttacactccttaaatgatgctcttgtattagaggacaaagtatctgccttacagtcccaagataaagccacatgccccagactttattatccctgtctttgagctagcct

SEQ ID NO: 41052 - DNA, 562 bp, Homo sapiens
caccttggcctcccaaagtgctgggtttaatgggctaggtgtgagccaccacaccccaccccttttctctattttaatgaaatatagacgcttgttatcctaaagttttctttttctttctttttttttttttttgccatgaagttcatgaacacactaaaatgttctatgcagcatatttttaggagcagattcggttcagataatttattatgtctgtgctgccaacttgaggctgcctgagagtttgttgggagctccaaactctccagtcaccacagaagccaccttttcacccagcgggcgcacactcgggatctgaactctctgatagatgggccatgctggggagacagcagcagcctgaaaagggttcacagccctccaagaaaaaggggagaaaagaccctgcatttggactgcaacactaaaggaaccctttcattgcttcatggaaaagagtttgggaggatattggccaggagcccagagctaggggatccagggctgtgggcaagttattaagggccctggaaaggccccattgggcaatttagggaat

SEQ ID NO: 41053 - DNA, 2507 bp, Homo sapiens
taaaaacaactcttaaggataaaacaaatttcagattaattatgaaaacaagaatgtggcagggcatggtggcctacacaagcaatcctaacactttaggaggccaaggtagaaggattgcttcagcccaggagttcaagaccagcctgggcaacacagtgagatcttgtctctacaaaaacaattttaaaaattagcctacatggcacaaacatcattttgtttgtacactacctatctgagagaaatgacttgaaaatgtgatattatcagctggatcagtcatctgatatgagctataaacgtgcagcacaaatgtcactcagagactgaaaaatgagtaaaaatcaataatttcttagggaaaaaagactgcctagaatcttattaaaaaacattctgggggtctatcagttagaaatattttggttacactgacagataaccaaattcaaatgggcttagagcaaaaaatgggagggcatagaggacacttacttgttcacataactggaaagctccaaggtcagttggtttcaggtaaggcttgatccagcagttcagcagtattactaaggacttgcctttacccatattcttccccatgcctgaatgtccaggtaagagtcattggtcattgtaaagatttgtccagcttccattcttcattcctaatctgagtttgttttccttttagagaataactccctagtgtgtttaatcttagtaagaaggtaattattccaggcaccagtttcatctctactgaaagggaaagaaacagatttcacctctccctttgcccttcccttcccttccccatccctaagtttatgagcagacatatgacttaagcttggtcaggtagatgctgtcttctggactttggatcttgacagagttccacgggatggaaggaacaggggcagccctgcagcatagcctttgctcctccccactgtcaaacctgctgtccatatctaatcaatcctggaagtcctacaagcatttccctttgcttaggttgcctatgtcctgctgtttgattgatagagcaacagagcctttgcaggaaagcccgtgcaaaggagaacctcccaccttgtgtccccagggcactaagtatcatatcttttgatgtgcccatatcgataaacattgtactactgacttagcaatctgtgttccccaccctactgagctctctaaaaacagagtacttagcttatgcttagcccagtgtctggtcaatattagatatttagaaaaatctgtgtgaatgaatgaatgaatgaatcactttagggagaaaggacatgcttgtattaaacagttcttaaatttaagtcatacattatcaagcacaaataataagggctctttacaaagtatcgaactgccataaggaacatttttaggctattttatgaggacttattctttgaggatctatatacctgtcaggatgaatcttggttcatccctgaaatttaatctgaaggcttcttcagtgcagattgctccctatctaataggggataaatatccattatgccaccaggaaatgcctctgacatttaaatgcatgccttatcctaactgaaataaaggatctcaattctccccagtttgcctgcagcaccactcccaggagccaagccctggcctggccaatgacaccacatgtgtagaaagatacactgggttttgcaggtgcgtcgggacgctctgaggaggggagggtaagacggtgacacgcactcctgccactcttacatcgaagcctgacccctgcactgtgtgatcacatacaggctcagcctcctgcaggggcacccgcattccagcctggcacggttgggcacccagcacctcccaggggagcagggcagtgcaccgaggagtcgagatgctccagcaagggtgggcataaaccagggctggtcttcctctacccttctccttcccttcccctccgagtaatgtgtgtctagccattaggtgagacagaggatatgggtgtgtgcccagagcaggacactgccctgagtccagtggggaggtcgggagggagccccctcagggccaagggtggcagaggagcagggaggtcgctgtcatatgggggactgaccaaagaagtcaatctattaagcatcacagaagccaggtttcttgtcagaaaacggagttgaaaatatgaggagggagaaaactagaattatcccttcaggtggagttggaatctgacccacccatctgaactggtggttttctaggtggctggtgtgttcatttcctacagctgctgtaacaaattgccacaaactgcggggctgaagacaaattgattctcccacagttccagagcccagatgtcagaactcaaggtgttggcagggccgtaatccccaaaagctctaggggagatttccttccctgcccctttcagcttctagtggctccacaacactgagtcctcacatggtgacctcgagagaaaggaa

SEQ ID NO: 41054 - DNA, 1514 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaactatagtcgacttgttttcagggctggatagcccagccatcctcgtcctggtcaactatatcttcttcaaagtcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41055 - DNA, 632 bp, Homo sapiens
gggactctgagtttgagacttgaggtctagcaccacttccagagccctcagaactgggacccactctaggcatggggagccaaggcacagtctgatctacccccaaatccaaggaccagtaccctcttggtctctccctacttccttgtttagaagccagtctcagaaacagagctcatcctcaacccattccaagaagtagaggatgaaacaggattttttctgggaatttttatatcttacctacacttggatagtaggcccgtgaggtcacctggaactgtgttttcctctctgccctacagacctgtctcctcctcttcctcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaagtggacctgccatcatgttga

SEQ ID NO: 41056 - DNA, 663 bp, Homo sapiens
cacagctggagccagggaccactgctcccagctgggcgctccctccagtcctctgcttctagcaggggttctcctgggactaaaaaggcttcattatggactattgtcttagatgctccatggtccagctgcatcccaggtggaatcagctcgaaggaattgcagagaagaaaagaatgtgcaattcagaggccccgtgggaaagctgcctgtgtcatggaggcagagacagatcctgcctcctgctctgtcccttctcctacccacaaagagcaagtcaggctggagggcaggagctggagggagcgcatgaggaaataagagtctggccaggagaagaggtgctgctctcccctctgccaggcccagccctggaatgtctaactctgtctgcttaccccgagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtaaatgtcatgggaacccaccttttcttccccctccaaaattcacaatataaatataatactaggaagtggcactgagttcgttcatgaatgagcctctaggtccct

SEQ ID NO: 41057 - DNA, 486 bp, Homo sapiens
gaccttctctgaccctggatttaccttcctaaaaccaaggatgtgaagggtcccagcaatgagtcaggaaagcgagaacgcacagcaggtctcactacccatcttcattctgtacctaacagtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41058 - DNA, 1447 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaactatatcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41059 - DNA, 1393 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaactatatcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41060 - DNA, 1373 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaactatagtcgacttgttttcagggctggatagcccagccatcctcgtcctggtcaactatatcttcttcaaagtcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41061 - DNA, 1453 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaactatagtcgacttgttttcagggctggatagcccagccatcctcgtcctggtcaactatatcttcttcaaagtcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41062 - DNA, 661 bp, Homo sapiens
gggactctgagtttgagacttgaggtctagcaccacttccagagccctcagaactgggacccactctaggcatggggagccaaggcacagtctgatctacccccaaatccaaggaccagtaccctcttggtctctccctacttccttgtttagaagccagtctcagaaacagagctcatcctcaacccattccaagaagtagaggatgaaacaggattttttctgggaatttttatatcttacctaaaaacccttgaggcttgaatggggacattccaagcatgcagaaggccactgtgtcacttggatagtaggcccgtgaggtcacctggaactgtgttttcctctctgccctacagacctgtctcctcctcttcctcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcag

SEQ ID NO: 41063 - DNA, 1400 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaactatagtcgacttgttttcagggctggatagcccagccatcctcgtcctggtcaactatatcttcttcaaagtcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41064 - DNA, 1120 bp, Homo sapiens
gggactctgagtttgagacttgaggtctagcaccacttccagagccctcagaactgggacccactctaggcatggggagccaaggcacagtctgatctacccccaaatccaaggaccagtaccctcttggtctctccctacttccttgtttagaagccagtctcagaaacagagctcatcctcaacccattccaagaagtagaggatgaaacaggattttttctgggaatttttatatcttacctacacttggatagtaggcccgtgaggtcacctggaactgtgttttcctctctgccctacagacctgtctcctcctcttcctcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41065 - DNA, 920 bp, Homo sapiens
cacagctggagccagggaccactgctcccagctgggcgctccctccagtcctctgcttctagcaggggttctcctgggactaaaaaggcttcattatggactattgtcttagatgctccatggtccagctgcatcccaggtggaatcagctcgaaggaattgcagagaagaaaagaatgtgcaattcagaggccccgtgggaaagctgcctgtgtcatggaggcagagacagatcctgcctcctgctctgtcccttctcctacccacaaagagcaagtcaggctggagggcaggagctggagggagcgcatgaggaaataagagtctggccaggagaagaggtgctgctctcccctctgccaggcccagccctggaatgtctaactctgtctgcttaccccgagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaatgacc

SEQ ID NO: 41066 - DNA, 1382 bp, Homo sapiens
  misc_feature (1350)..(1350): n is a, c, g, or t
  misc_feature (1373)..(1373): n is a, c, g, or t
cccacgcgtccggttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacacatacttgctttattcaccttcctggtttgggttgcgtctttccttgaatattttattggcccaaattagcctttctcaattatggttccagactggggccnggaattcttaaaggaaaatgtgngctctttaa

SEQ ID NO: 41067 - DNA, 950 bp, Homo sapiens
  misc_feature (918)..(918): n is a, c, g, or t
  misc_feature (941)..(941): n is a, c, g, or t
gctgttttattttgggggagagaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacacatacttgctttattcaccttcctggtttgggttgcgtctttccttgaatattttattggcccaaattagcctttctcaattatggttccagactggggccnggaattcttaaaggaaaatgtgngctctttaa

SEQ ID NO: 41068 - DNA, 1474 bp, Homo sapiens
  misc_feature (1442)..(1442): n is a, c, g, or t
  misc_feature (1450)..(1450): n is a, c, g, or t
  misc_feature (1460)..(1460): n is a, c, g, or t
cccacgcgtccggttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtgaggagcacattttgttaacattcagatttaattactgtaagtaaaatttaaaatgtaaatacatcagttcatgttctgtattgaaataggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacacatacttgctttattcaccttcctggtttgggttgcgtctttccttgaatattttattggcccaaattagcctttctcaattatggttccagactggggccnggattctnaaggaaaagngggctctttatggg

SEQ ID NO: 41069 - DNA, 338 bp, Homo sapiens
accagctgtgggttggctttactaggtgatgtgtgattgactgactcacctgctggagtagcaatgcattctcaccttttgctgatggggccttgtttctaaacacgtggatgcgcagagagcaaggctcagcctactgcagccatctctggcagcgcttctacccctccccagcccatagatgggattgtttaaatctcccttgttgacctagtggcaattcttcctctacctaaatagtcgatgtgagtgaaatcattctcttttgataggtggttgctagcagttaacaaccatttatttactttaacaattaataataaactttataaactgtc

SEQ ID NO: 41070 - DNA, 479 bp, Homo sapiens
tttgagcacaacttccgtcccatcattggctgactactgtgctacaaagatgcaggtgcaatccgtaaaaagccaggcttaaagataaaaacgaattttttaaaaacccaactgagcagaaccatcaggggctgcacaacaagggaagacagatttttctgaattagcctatgccggttactaaataaagatagaaacaacaaccttcagggggaaaatcagagccagagtagctacaatgtattatctgaatgtccattttcacctaaatttgagacattaaaaaataacaggaaagtattgtctcaccctcaagaaaagaggcagtcagtaggaactatctctgatccagctgttggattcatttagcagacaaaggcttcaaagcagcaattacgttcaaagaactgaagaactaaaggaaaacgtggaaatgaatcaacagacagacactctccaaaaaacaatagaaattacaa

SEQ ID NO: 41071 - DNA, 842 bp, Homo sapiens
gcagaggtaatcaccatccaaaagttggtatttctcactcgtggtcatttcacacatccctttttaaaatagaatggaatataggaaatgtggaggaagctaaaggaatgggggcttttaaggcttccagtggagcagatcctaacccttggtcagtataatttggctctaggttcaggactgctggcagggtgagaaacatgttggatatagagttttcattttctgaagacaagtcagaaacagcacattcttcctgggattaaattcaaggacaaatttgttgtttggcttttctctaaaagatagtgacacagtgattcaattcttcaggcagtgtattacccaaagattcttgaatccttttcaatttgatggctcttttgttgattctctataaagatggagcatacagtgttaacttttagttggtaaaagtgcttctgtgaagaactatataatgtggcctactttgtttttctgatgagttgccagtgcaaaggtaatatttggagaatcaagacgagtaggcagtttacatgtctgtcaaactctgtctcaaatacctggttatgaaatggctttcagatgggtgctgggtgttgtgccatctaagagctgggtgtggaacaagtgcagcagtactcgggtttcctcatctctattggtggctgtcattggatctgtaagccttggatactaccaggaagggaggcagagtttacctttcagtgtgagcatttcaaagccagacctatattctttttcagagggaaggccagtccacttaattacaagcacagccaaaaaggattcctgtagtattttttccttgaagaaaa

SEQ ID NO: 41072 - DNA, 340 bp, Homo sapiens
aattcacaggagggtagcagtcattcaactgtagtataatttggaattgcagctcacttcactttaagcagttcatctcagttctaatcattatgttcaaagcttcactctatccagatgccaagtttccccaactgtacaaaagcacaggagaaatatttctgtttggcaaggcctggcaaatttttggaggcgttgtcatgcctcaacagggcaccagtcaggttataatttgccttaattgcttgtgccacaaacagcaacaatgattacctctaggtcattgggcactcaaaggaaagatttcttcccagctactgtaaataacaaaatactttct

SEQ ID NO: 41073 - DNA, 404 bp, Homo sapiens
gcgtcgacaaaaatacaaaaattagccgggcatggtgtgcgtgcgtctgtagtcccagcctcccagatagctgggactataggtgtgcaccactgtgcccaaccactttttaaaaaatttctgtcacgcctgtaatcccaaagtgctgggattacaggcgtgagcactgcgcttggcacgatagttttatttctttcagtgcttgaagaatgccatcccactgcactccagcctgggtgacaaaatgagactccgtctgaaaaaaaaaaaaattgtaatggggccgggcacggtgctgcgtcgcctgtaatcccaacactttgggaggctcaggtaggaggatcacttaatcccagaagtttttgagaccagcctgggcaatatagtgagtccccatctctacc

SEQ ID NO: 41074 - DNA, 626 bp, Homo sapiens
tctctgggtcatgcaaagttatgttattcaggaaaaaggctgaagcttgttgagtcattaccaattgtaagaatttggggatatctgaagatcttaggatatatatgccttgagaatgtcaaatatctgctgtatttgtagggcagcaaaaatgtgtacaatattgatcttgatctgctgggcgcggtggctcacacctgtaatcccagcactttgggaggccgaggcgggcggatcacgaggtcaggagatcgagaccatcctggctaacacggtgaaaccccgtacctactaaaaatacaaaaaattagctgggcatggtggcgggtgcctgtagtcccagctactccagaggcttaggcaggagaatggcgtgaatccaggaggcagagcttgcagtgagccgagatcgcaccgttgcactccagcctgggcgacagaaccagactctgtctcaaaaaaaaaaaaaattgatcttgattatttatgatgttattttgtttgcttaaatttatgtacacatctataagcgttttaaaaacattaaaaatactagtatggtatatggtttggtgttgggaagtagagaaacttaaggaaggtaaaggaatatctaacaagtttcc

SEQ ID NO: 41075 - DNA, 205 bp, Homo sapiens
ctaaagaggtaactaaagacgctaaatccagtcactgaggtgggagaacgcagcccaagtaacccacagagatgcctgcggggccaggcaggcctgggggggggcttgtagtctttggacacagacatacttgattacatgtttaacacacacgaacactctacttccaaaaagaaataggctcttgcctagtttaagcacaagc

SEQ ID NO: 41076 - DNA, 483 bp, Homo sapiens
gtcaaagctggaaggtggaggagagatcaatgattttagcaacactcacccactgttgctgacaagtcaaaagctcataagccacagaagatggtgttgctttgttttcatggtggaaaacacagctcgaagcttgaatttggtaatgcatactacagaaaagcagtgaatgtatggactgcagaagctacatagctcctcattcttcactctattttcataagcaagatgcaaatgataaagcagcaagctgacattcaagaaagcatgtttcagggcatatcttcctgaggttggtatgctttcatgctggcagctcataatttctagaaacacagcaaatcaccatgatttgtgatcattaagcaacagttagatcgtgttccaattcctccatttgtggggcagaaaaatcgtgtcatatttcagaaaaaaagatgcccaaataaaaggtcaaaataaaattgggtgcttaaaaataaa

SEQ ID NO: 41077 - DNA, 439 bp, Homo sapiens
cacaataaaagatattccacatcattagccatcagagaaatgcaaatataaaccataatgagatatcattacccatctattaaaatggctaaataaaaaaaattgataaggaggggattctgggaagatcaaaaagtagaaagcaccaggaatgtatctcctcacctagagaacaactgcatggcataatctgtctgatgtaactattttagaactctagagtctattgaaggcttttaatttccaagagaaggcttgggcagtaaattgcccttaactgtggttgactttagctcttagaataatatcagctactcataccccactcgcaggcatccttgcacagattccaggagtagcctggcacacagtttatgggagccagggtgttgcaaaaagggccactgtccattccaaaaatcaggaatctgttctctga

SEQ ID NO: 41078 - DNA, 397 bp, Homo sapiens
gggttttgccttgttgcccaggctggtcttgaattcttggctcaggtgatccgccctcgtaggccccccaaaatgctgggattgtaagtgtgagccactgggcctggcttagttctatttttagttctttgagaaatctccaaactgtttttcacaatggctaaactaattacattcccaccagcagtgtataagtgttccctttttggggcagcctcgccagcatctgttagtttttatctttttagtaatagccattctgactggtgtgagatggtatctcgtggttttgatttgcatttttctgtttagttatgtggagcattttttcatgtttgttggctgcttgtatgtcttgttttttgagacagggtctcactcttgcccacgctggagt

SEQ ID NO: 41079 - DNA, 426 bp, Homo sapiens
attttctgctaggcgtctgtgatattagtaatttaaacaaactgatgggcttatataagaccatttggagaggactgaactccaatattttatggcagtgaagaatatatgtgtacccccaaggggcatcctgaatctcctgccacctgcctgaaattgctttgaaatctcaatttttatttcaaaaactcaagggaagtttgcattaatgataggaacacagagtgcaaagaaccagggccagttccttatgtgatcccagttcccagatctacaaataagtaatactgtaatatgtaatagggccaggcgcagtggctcacgcctattaatcctaggcactttggggaggccaaggcgggtggatcatttggggccaggggtttcgagaccagattggggcaacatgacgaaaccctgtctcta

SEQ ID NO: 41080 - DNA, 451 bp, Homo sapiens
gctcattgcaacctctgcttctcgggttcaagtgattctcctgcctcagcttcccgagtagctgagattacaggtacaccgtcacgcctggctaattttgtatttttagtagagacagggtttcaccatgttggccagggtggtctcgaattcctgagctcaagtgatttgcccaccttggcctcccaaagtgctgggattacaggcgtgagccactgcgcccggcctatctttctattaagatgttctccactgggcatggtggcttttctatttcctaagaggactcagaataagtcatagggcctgtctgagttgttctccagagacaagggaagaagtattttcctcccttgagcatgtttaaaaagactgggccggacacagtggctcatgcttgtcatcccagcactttaggaagccaaggcgggcagatcacttgaggtcagga

SEQ ID NO: 41081 - DNA, 414 bp, Homo sapiens
tatcaaggttctatcctgggctcttttctcactctaggtattttcccattcagactctatgattttgatggccacaatttaccatcaattatgtggataactcccaatatgtatcttactcagttcacttttccaagtttcaaaatcatttatctaattgccttatggaatcccaacctgaatgttctataaattcttcaaacattcaaaaccaaactagttattttcatttaacattttattgtacccttgttcgcaagggtacaataaaatggacattctggccaggcacagtggctcactcacgcctgtaatcctcacactttgggaggctgaggtgggaagatctcttgagcccaggagtttgagactagcctgggcaacatagttagaccctatctctatttttattaa

SEQ ID NO: 41082 - DNA, 1319 bp, Homo sapiens
  misc_feature (453)..(453): n is a, c, g, or t
tgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacanagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaattggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatagcaggtgtcaccacctcctgagataagaaacatagttttatacattatgtacagtgtagcagtggttttgcctagtgttccaattttggaacgtcacataacaatggaacataataaatttttttttctcttcaaatttttgttccttgaatttttctaggtaacatatatgaatttcatgcaaaaattcaaaaaattgtaacctcagacataaatgggttaaagatgtt

SEQ ID NO: 41083 - DNA, 1223 bp, Homo sapiens
  misc_feature (453)..(453): n is a, c, g, or t
tgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacanagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaattggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatagcaggtgtcaccacctcctgagataagaaacatagttttatacattatgtacagtgtagcagtggttttgcctagtgttccaattttggaacgtcacataacaatggaacataataaatttttttttctcttca

SEQ ID NO: 41084 - DNA, 421 bp, Homo sapiens
agatgtttactaagccaagaatcctatatccaaggaacacagaaaggagagccagttcccagtttagtaataagaacacagctacttggtagaagtgaaaaaccaccaagaggatgccttaaggattaaatatgtcaagtagttccatttgggctcatttcatccattttctgaatctcaagctccttgtctataataagcaactctaactataattgcaaacacacaggcgcacgtgcacacacacatccccatacatgcacacccatccagttagcatagagaggttgcacactggtcatttgggaaatgcaaactaaaaccacaatgagacaccacttcaccctcagtaggagggcctcgtgtctagcttccatggagagaagggggtcggaataagtaactccactgtgtaggttgg

SEQ ID NO: 41085 - DNA, 710 bp, Homo sapiens
aagctctcaggtgagtgcctggcacatggcaggtgcctggtctgcccctattctcgaatctgttccgtgtctctctcccctggcaaactgcaggagtgtctgctatgctcacccccagcccattcttcttaatccccagcatggccatgtggcccatgtggtgtcggcagtaaatcaatatttgttgaatgaattaataaatgaataaatgagtaagtcttcttccaacagaaatgacctcagacttgatttcaactagaagcccagatgaacacacctgctcagatcgtgcatttgccccagcgtgtggactccttattaagggccttaagattccatgggaatccgcagagcacagatgtgtgtatgtggggtgcggggggtgaggtgtgggttgggggatgctgggcgggagcagcggttgcccagcctttgccagggaagggccggttgtgtgggtggagcccatctgcaaggcaatcacacttcaaaagcagaggctgaaggcaagtggagactcgctcctgcttgctcctgagcctccagggcttcccagcttccacctctgatctcggaagtcttacctgttcaagtgggggagggcaaggggcagctggagctcccaaggttctccgcaccccaccctcacttcagaccaacacacaataagttattgtaccaggacacttaccagcaataaaatgagtaaa

SEQ ID NO: 41086 - DNA, 439 bp, Homo sapiens
ccccactgcccagagattctgtcttagtccattcaggttgctgtagcaaaatgccttagactgggccatttataaacaaaagaaatgtattgctcacagttctggaggctgtgaagtccaagatcaaggtgttggcagattcaaggtctattcctcacagacagtgccttctatgcatcctcacaggaaaaagaggccaacaactccctcaggcctctttttttttttttttttcagacagagtctcacccaggctggagtgcagtggcacatctcagctcactacaccttcacctcccgggttcaaacattctcatgcctcagcctcctgaatagctgggattacaggggcatgccaccacagctggctaatttgtttttgtatttttaatgcagacggggtttccccatgttgcccaggctggtcttgaagtcctgg

SEQ ID NO: 41087 - DNA, 890 bp, Homo sapiens
cttcacaataaaactacaaacagacactgtcgaataaattgagtgataagtatgtctatttactaacatgagccaatttgaactttagttttgagatctaaaaatattttaatccacatgcatttagtgactataaattgaaggcagtgttcttttgacaaccaagcttattgaaaactttggcattaatgttcacaaacatgagcactattttgaaattaaaaatagactatggtttgctctacatgcttgtgaccctgcaaaaaataaaggaaaaatattcatgcgatttttctcctcttacattcttatggcttaaaaaatataaccagggttttatctaattttaatcaatctcttggcaaaggatcatataaggttttacctgctaacaagaatacctcatttgaaagagcattaccacaagcattggagggaggtacagttgacatggtgaatttgattttacaaaaactaacaaagctggggggtggcaaagcattgacttaactataatcactagtcacaccaatgtgagattccgaatcattggtcagccacagtgatgccaccttggcatcaaacttgcctgttccatctttatcaatgtatctggaagtctgacttgagtaccagaagccaaaacgctcagaatgctaatttgtgccaccttaatggcccatgtgttcggtaaataaatttgctttttacatctcgtcaaatcttactgaataaacctttcatcagagttctacatatccccaggtgggcttggaaacgtgagataggattttattgtgttttatattatgatagttgaatgatgattctatatgttattgttatatttgttttcattaaaaacccaaagaactaccctttgtatacca

SEQ ID NO: 41088 - DNA, 493 bp, Homo sapiens
agcatgcatgctagaggttctgcaaacactgtcattcggcagtgtacacgatgattagttgtctcatcaaggagagcttagaagaggtccctgcagagaaccacccactctggctgaaggaccagcctttgtgatccaaccagcacacctcctattatgaggtcatgtcttgcttatcctgagaccgctggttggcagaggtcttgaactattaagagtacatgaagttaatctatttatttgctcatcgatctctttttatgaaacactgtagaaccctgaggtgcaagcagcatcatttgagatgcctctgaggcaggataatgcgtgggagagacgcgttcttcccgacaccatcctggtcatttggggctggcaccatgatggctctggaatgttggtggctgtgcccagtgacaggcaggagagaagtgatggttccccgtggggcctgcgattcttggtgaagcagcagttgtttccaggaggagac

SEQ ID NO: 41089 - DNA, 1361 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttcca

SEQ ID NO: 41090 - DNA, 324 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactactgttctcctcactgcctcttcctattaggaggatggtgaagccagccacggttttccccagggccagccttaaggtatctaataaagtctgaactctcccttcca

SEQ ID NO: 41091 - DNA, 2900 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaaggtataaccagggaattgttccagaggtttccttggatattcctacaactgataacagctgtcatttcttcagcatctactgtaaccgtaattcctgggcacacatggcagctcagaaatgttgcctgacctactttgaggagatgatttgagcgaaacacccattctagcctggatgacatgaacatctccgtttggctttgtgcttagactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctcctgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccatagtgactaatgctgtaaagaagatatgtggggtgctgtaagagcagaataaagatcttgccctaggccccagggacaggggtatgcttccttgaggtgaagtttgaaggtgggctctcacaaatgagtgagctttattcaggccgagagaagagcttgacgtgactttttggtatttgcttcacgattcatttgctcaaagcaaagaacagaggcttcagggtgtctcccttatcacctggccctctgtaccctgcactcaggagcctcattcaggacgtatttattgagtgcctagtgtgtgcccaaagctaaggataccaatgaaagaagtgctgctggccctcaggttgcttagcctagtgcaagattgaccagtat

SEQ ID NO: 41092 - DNA, 2894 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgagtgtacagccttggcctcaaaggagccattgtgaccttatccaggctgggatctgttgattgaggacagtggcatcccctcgagttgcatggcgccattacattcacggaggacgtgaacgaggtataaccagggaattgttccagaggtttccttggatattcctacaactgataacagctgtcatttcttcagcatctactgtactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctcctgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccatagtgactaatgctgtaaagaagatatgtggggtgctgtaagagcagaataaagatcttgccctaggccccagggacaggggtatgcttccttgaggtgaagtttgaaggtgggctctcacaaatgagtgagctttattcaggccgagagaagagcttgacgtgactttttggtatttgcttcacgattcatttgctcaaagcaaagaacagaggcttcagggtgtctcccttatcacctggccctctgtaccctgcactcaggagcctcattcaggacgtatttattgagtgcctagtgtgtgcccaaagctaaggataccaatgaaagaagtgctgctggccctcaggttgcttagcctagtgcaagattgaccagtat

SEQ ID NO: 41093 - DNA, 2462 bp, Homo sapiens
gcggccgctcccacttcagattggtatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctcctgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccatagtgactaatgctgtaaagaagatatgtggggtgctgtaagagcagaataaagatcttgccctaggccccagggacaggggtatgcttccttgaggtgaagtttgaaggtgggctctcacaaatgagtgagctttattcaggccgagagaagagcttgacgtgactttttggtatttgcttcacgattcatttgctcaaagcaaagaacagaggcttcagggtgtctcccttatcacctggccctctgtaccctgcactcaggagcctcattcaggacgtatttattgagtgcctagtgtgtgcccaaagctaaggataccaatgaaagaagtgctgctggccctcaggttgcttagcctagtgcaagattgaccagtat

SEQ ID NO: 41094 - DNA, 993 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagccttctaggccgggcgcagtggctcaagcctataatcccagcactttgggaggctgaggcgggcagatcacgagatcaggagatcgagaccatcctggctaacacggtgaaaccccgtgtctacta

SEQ ID NO: 41095 - DNA, 1393 bp, Homo sapiens
  misc_feature (1167)..(1167): n is a, c, g, or t
  misc_feature (1170)..(1170): n is a, c, g, or t
  misc_feature (1172)..(1173): n is a, c, g, or t
  misc_feature (1195)..(1195): n is a, c, g, or t
  misc_feature (1199)..(1199): n is a, c, g, or t
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaagattaggaaactaagactcagaaaagaggaaatgcttaaccaaaatcatatagtttataagggctccagagagtcagagctggcctcagtctctccgaactcaaagcctcttaaccttccagaacctccacccaaaatgcctagacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaggagctgatctcanaangnngaccatcggcgaggcagtcaangccngcgtccagtgccggcggaacaggctggcttggagctcataagcctaaattcaaggatctcccaggaatccaaactggtcgaggaggggggctggggggaacgcccggggcacgccaaaggccagccccacgagaggaacagggccgggaaggaacgagccaacaaaaacgcggcgcacggcgaaacgacctcac

SEQ ID NO: 41096 - DNA, 682 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagccttaaggtatctaataaagtctgaactctcccttcca

SEQ ID NO: 41097 - DNA, 470 bp, Homo sapiens
gagacagggtctcctgttgcccaggctagagtgcagtggtcattcacaggtgtgatgatggtacacaatagccttgaactcctgagcacaagcaactctccttcctcagcctcccaagtagctgggactacaggtgcgtgctaccatgcccacctttattcatcatgaaaccccttggcacagtatctgatacttcgactgtccataaatatttgttgaattacgtttacttgaattttccaaaacgttgctgtcttcctttcagtgactcagtgattcttttcagaggtataaccagggaattgttccagaggtttccttggatattcctacaactgataacagctgtcatttcttcagcatctactgttaggtactaccataaatgctttacatacattaactcatttaatcccgtgaactgagttctcgtgttatcccattttacggaggaatattctgaggtttat

SEQ ID NO: 41098 - DNA, 509 bp, Homo sapiens
cagtccacgcacatctccctgaagaaagttgacatgcattagagaaactggggactggccccattgttcctctctggaaacctccctttgcctcttggttggttaaagcccattccccctagccaggcggcaggcagcacgcattaagtgcccagatgctgggagggaggcatgagaaacagagtttaggaaacccagtatgacttgcagtttaaacgtttgtggtgggccgcatcagcccacatgtgtgactcttagaactggcaggagaggacctgaggaaacagagacacagaaagagaaagaaaagaagtaacctttcccaaccacctgccttacattttatctgatgatttccacaaaagcttttcaaaggaactgttatctgttttacagattaggaaactaagactcagaaaagaggaaatgcttaaccaaaatcatatagtttataagggctccagagagtcagagctggcctcagtctctccgaactcaaagcctcttaa

SEQ ID NO: 41099 - DNA, 2689 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctcctgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccatagtgactaatgctgtaaagaagatatgtggggtgctgtaagagcagaataaagatcttgccctaggccccagggacaggggtatgcttccttgaggtgaagtttgaaggtgggctctcacaaatgagtgagctttattcaggccgagagaagagcttgacgtgactttttggtatttgcttcacgattcatttgctcaaagcaaagaacagaggcttcagggtgtctcccttatcacctggccctctgtaccctgcactcaggagcctcattcaggacgtatttattgagtgcctagtgtgtgcccaaagctaaggataccaatgaaagaagtgctgctggccctcaggttgcttagcctagtgcaagattgaccagtat

SEQ ID NO: 41100 - DNA, 852 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcataaaaaatgtgaggggaccgggtgaagccaggagactggtgacttcccaagggcaaaaaatttgggccttttgggggattttctaaagggggggaaacaaccccctttgtgtgggggcggggggtgaaaaccctcctgtgaacggcgcgcttgggtcggtttctccaccaacagcgggtccgcaggggacacaaatgggcggcgggaaaaaagggcccacaccttgtgggtaatttctcccccagaaaaggggttttttcccccccgggaaagcggcgttgtggaagcaaattttttccgccaccgtttttcctttttctcgcaccagcacaccgccacaatactagcggggcgtcgcaactcacacaccaaatcctcgcatccggtgcggtccaagtacacaccatcgcagtcgacgcagtagcgcctgcgtccaacactcacatcaatcaagtagttatg

SEQ ID NO: 41101 - DNA, 2816 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaaaccgtaattcctgggcacacatggcagctcagaaatgttgcctgacctactttgaggagatgatttgagcgaaacacccattctagcctggatgacatgaacatctccgtttggctttgtgcttagactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctcctgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccatagtgactaatgctgtaaagaagatatgtggggtgctgtaagagcagaataaagatcttgccctaggccccagggacaggggtatgcttccttgaggtgaagtttgaaggtgggctctcacaaatgagtgagctttattcaggccgagagaagagcttgacgtgactttttggtatttgcttcacgattcatttgctcaaagcaaagaacagaggcttcagggtgtctcccttatcacctggccctctgtaccctgcactcaggagcctcattcaggacgtatttattgagtgcctagtgtgtgcccaaagctaaggataccaatgaaagaagtgctgctggccctcaggttgcttagcctagtgcaagattgaccagtat

SEQ ID NO: 41102 - DNA, 2969 bp, Homo sapiens
gtagacgagaaagtctctggccagtgacaatttctccctacctcttcttcctgctcaaaatgatattgaccgtttgatgtgattgagtaaaagatgaaagataagtacaaatgattgctaattaaatgtggaacgcaggaaagatatctcagcagagctagctaatgcccaccttacacagcaagtataactgtgccagtccccagggtactggcctcttttcccccctctcaaaaggctctttcttctgcctgcttttgtctcccttgtacttcatatggcatcacaggtgtacagccttggcctcaaaggagccattgtgaccttatccaggctgggatctgttgattgaggacagtggcatcccctcgagttgcatggcgccattacattcacggaggacgtgaacgaggtataaccagggaattgttccagaggtttccttggatattcctacaactgataacagctgtcatttcttcagcatctactgtactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtgagcctgctcatttttaaggatctcaaacttcgaggcttttggttgtcccagtggaagaaggatcacagtccagaccagttcaaggagctgatcctcacactgtgcgatctcatccgccgaggccagctcacagcccctgcctgctcccaggtcccgctgcaggactaccagtctgccttggaagcctccatgaagcccttcatatcttcaaagcagattctcaccatgtgatcatcccaaaagagctggagtgacatgggaggggaggcggatctgaggggctgggtgcaggcccctcagttggggctcccaccttccccagactactgttctcctcactgcctcttcctattaggaggatggtgaagccagccacggttttccccagggccagccttaaggtatctaataaagtctgaactctcccttccaaaaagtagaagtcatccctgtcgagaaggaccaacactgtgcactggtcagctcacagcaccaagaggcccccttcctgcttttctgtcatgtgttcccccagtaatcattttctgaccaccctgaaagcaaagcctgggtgggtactggcagtgcaaaggccagtaggccaccatccctggccccaagctgcacaagcccacagacgagggtcctgtagaacaaacgctttgatgtgcttctcaggtagcctgcggcccagtccagggcttggggaggatcagctgcatggaagagtgaatgccaggctgaggtcatcagggccctgaggaacttggacgtggggtcttcactctcatggaactgcccttctaactggagacatagacaatataccagtggttctcaaccagaggcaattttacccccaggagacatttgacaatgtctggggatatttctggctatcacagcttatgaaggaggttgctactggcatctagcaggcagagtgagtgctgctgttaaacccaccacaggacacagaacagtctcctgcaacaaagaattacccaaggcctggcgcggtggctcacacctgtaatcccagcactttgggaagccaaggcaagcggatcacttgagcccaggagttcaaggtcaacctaggtaacgtggtgaaacaccatctctacaaaaaatacaaacattagccaggtatggtgctgtgcacctgtagtcccagctactcgggaggttgaggtgggaggatcacctgagcctgggaggtctagactgcagtgagccatgatcatgccactgcattccagcctaggcaacagagcaagaccctatatcaaaaaaaaaaaaaaaatctagccccaaatgttcaatgttcatgaggtcgttgataaaccgtgcattaaacaatctcacagtaattaccatagtgactaatgctgtaaagaagatatgtggggtgctgtaagagcagaataaagatcttgccctaggccccagggacaggggtatgcttccttgaggtgaagtttgaaggtgggctctcacaaatgagtgagctttattcaggccgagagaagagcttgacgtgactttttggtatttgcttcacgattcatttgctcaaagcaaagaacagaggcttcagggtgtctcccttatcacctggccctctgtaccctgcactcaggagcctcattcaggacgtatttattgagtgcctagtgtgtgcccaaagctaaggataccaatgaaagaagtgctgctggccctcaggttgcttagcctagtgcaagattgaccagtat

SEQ ID NO: 41103 - DNA, 1383 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgtaagtcccttgggcctgcaggtccagctcgccagagctctccaggtctttagctgggaggaccatcaagtgactgagtcccatcgccagttcgagccaagtccaggtcagcacaatgttgagtggaaactaggaccaaagtcatccagctatttgggcactggtttctcagccttcccctttgcagatgaccaaaattttggcctatccagctttatttttccaagggaccccagaagtagactgctaagctgcctgccatagaggaatagtcaaggatttataacctagggatgtctgaaaaagtcacttagtcctaacttatttaacctttcaaaatttgtattagcttttaaaatagattctaattttaaaggtaacattatgcttattacaaaccattttgaaaacatgtaaaagtgcaaaggaaaacttaagcataaaagtttcctgttgctgggcactgtggctcatgcctataatcccagtaatttgggaggccaaggaggaagcat

SEQ ID NO: 41104 - DNA, 1181 bp, Homo sapiens
tagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgaaggtataaccagggaattgttccagaggtttccttggatattcctacaactgataacagctgtcatttcttcagcatctactgtaaccgtaattcctgggcacacatggcagctcagaaatgttgcctgacctactttgaggagatgatttgagcgaaacacccattctagcctggatgacatgaacatctccgtttggctttgtgcttagactcaagaacctggagctagctgctgtgagaggatcagatgtccgtgtgaagatgctggcggcccctatcaatccatctgacataaatatgatccaaggaaactacggactccttcctgaactgcctgctgttggagggaacgaaggtgttgcacaggtggtagcggtgggcagcaatgtgaccgggctgaagccaggagactgggtgattccagcaaatgctggtttaggaacctggcggaccgaggctgtgttcagcgaggaagcactgatccaagttccgagtgacatccctcttcagagcgctgccaccctgggtgtcaatccctgcacagcctacaggatgttgatggacttcgagcaactgcagccaggggattctgtcatccagaatgcatccaacagcggagtggggcaagcggtcatccagatcgccgcagccctgggcctaagaaccatcaatgtggtccgagacagacctgatatccagaagctgagtgacagactgaagagtctgggggctgagcatgtcatcacagaagaggagctaagaaggcccgaaatgaaaaacttctttaaggacatgccccagccacggcttgctctcaactgtgttggtgggaaaagctccacagagctgctgcggcagttagcgcgtggaggaaccatggtaacctatggggggatggccaagcagcccgtcgtagcctctgtggtaagctgggtgcagagggaggcatgcctggagccgggcca

SEQ ID NO: 41105 - DNA, 416 bp, Homo sapiens
atgttgcccaggctgctctgaaactcctgggttcaagccatcatcctgccttagcctcttaaggagctgggattaacaggtggcatgccccccaggccccagttccatatgattttcctgaaaatacaaaagaaagagggagatacaaaatacttttttaatcatgttcttataattatcttaataaaaatcaatttgctctgaatgccatgacctgctgagtgtcccaacctaagggttgtcagaccattttctcatatatgcatgtatagaagtagggaactaatatatttttgtctaaaatgtttaagatgaagatgagaatgaattccacaatatataattttgcctgaactatataagacagttaaaattatagagacattgcaggagagactctggattagatagaaaaa

SEQ ID NO: 41106 - DNA, 744 bp, Homo sapiens
ggattaatgaggaaatcattctgtggctctagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtcccagcccaccgcaccccaactttaatcagagtggttcactattgatctatttttgtgtgatagctgtgtggcgtgggccaaacatttaatgagaagttactgtgcaccaaactgccgaacaccattctaaactattcatatatattagtcatttaattcttacataacttgagaggtagacagatatccttattttagagatgaggaaaccaagagaacttaggtcattagcgcaaggttgtagagtaagcggcaaagccaagacacaaagctgggtggtttggtttcagagccagtgcttttcccctctactgtactgcctctcaaccaacacagggttgcacaggcccattctctgatttttttcctcttgtcctctgcctctccctctagctcccacttcctctctgctctagttcattttctttagagcagcccgagtgatcatgaagtgcaaatcttgccatgtcagtcccctggttaggaaccctccaatggctcactttctctttaggcaaaagtctttaccccatgccttctc

SEQ ID NO: 41107 - DNA, 429 bp, Homo sapiens
aagaaggcataaaggtgagagattgttcgtaaagtactttgaggttgttggatgaaaggtgataggtaaacacaaattattataatcatggggaaggttaatgaaaaaaactctggtccctgggaacaaactgtagaactctcctgcggtaagcaggattcatgaaaaatgagctattttctgtcctagccttctgatttaaaatttggtgtacatgttaacaatacaataaacctaatatttggaaaatgcctggaaatcgttgctttggacaggaaatctggatttcaggaggtcatattaatagcatgtttatcttttcctccttgaagaaaaataaaatccactccaaaacactaatcatactaatttttagcagtatacttgggccttcttaagatttaagttttttctagggggaattaattt

SEQ ID NO: 41108 - DNA, 303 bp, Homo sapiens
agtttgccattaccacacaatttaaaattaaagcctgatcctggtctctacaagaaatatacgtaggttacaattactcttccggcctgggcgaggtggctcacgtgcctgcaatcccagcactttggaaggctggtgggaggatcgcttgagcccaggagtttaacaccagcctgggcaatatagggagactgtgtctctacaaaaaatgactattctgtgtccgtttacccttttctgatagactaatattgtaccatatacaagttatttaataaattttagtaaatactgtttaattga

SEQ ID NO: 41109 - DNA, 447 bp, Homo sapiens
tgataatttcaattaatgctgaaaaatcatttaataaaattcaatattgttcatggctaaaaaaaaaaaaaaaaaactcaaaaagctggtaatggaagaaacataccacaacataataaaagccacatacaacagacccacagctagtatcatactgaatggggaaaaactgaaagccttttctccaagatctgaaacaaagcaagcatgcctactttaaccactgttgtttcacatattactggaaatcctagctagagcaactagacaatagaaagaaataaatggcctccaaattggaaaggaagtcaaattatctgtgtttgcagatcatatgattttatcggtggaaaaccctaaagactccaccagaaactactagaactaataaatttactaacgttgaaggatacaaaatcaacataccaaaatcaataacactttcat

SEQ ID NO: 41110 - DNA, 355 bp, Homo sapiens
gttttgttttgagatggagtctcgctctgtcgcccaggctggggtgcagtggcgcaatctcggctcactgcaagctccgccttccgggttcacgccactctgcctcagcctcctgagtagctgggactacaggcgcccgccacctcgcccagctaattttttgtatttttagtagagacggggtttcaccgcattagccagggtggtctcaatctcctgacctcgtgatccgcccgcctcggcctcctaaagtgctgggattacaggcgtgagccaccgcgcccagctggcactgacttttgaatgctggtattaaataaatataaataatggtattatgtttatgtttaaatat

SEQ ID NO: 41111 - DNA, 391 bp, Homo sapiens
tttaaataaaggaaaacagaactatagcaaagcctaacaatgtctgttaaatgaatagaaaatagaatgagaacaattaataagaaataaatttaaagagctatgagatttctgaggagagaatggttacttctggtgtgaagggttagaaagatttcacagaaattgcatttgtgctagattttgatggatggtaaagagcaacaggcaacagagatgaaaggagggaatgaaaccttaaattatgtccaggaaactaggagtggcccagttagacatgaacacaggagatgtgttggttgggggaagaagttacagataaagtctggaaatgcagtttgagagcagacttggagaactctgaaaccctcaagtcaactggctcagggga

SEQ ID NO: 41112 - DNA, 561 bp, Homo sapiens
catttcctttaatcgtgaagcatatcatacatacaaaagaagataggtagtgtacatgtacattttaaagcataataaataaaatgaacacctgtatactctccacccagtgtgaggaacagaatgttactagaaccgtcaaagccttcccagaggcatccacttcttccctgtcaaccatatccacagcttcttgctgtcctgaatttcttgttaattgtcgccttgtttttctttagtgttttaccatgtacacgtccttatacaatgcactgtttgatttttaaacaatacctgaatggcttcacatacagtcttaagcactagcttaagccaacctgttcttcttttataactgccctttctcagaattaagaaaagaagttgtagctaaaataataataaaagaatggttaactacaaaagtaatagacaggctaagaatacccttcttttttgaaaaatacaagtaagaatattgtcattaagaattatctggttgcagggagctgagatcacaccactgcaccacagcctgggcaacagagtgagactgtctca

SEQ ID NO: 41113 - DNA, 698 bp, Homo sapiens
ggtagacctgggttggatcccagctctgccttgtactagctcttgaccaccagcattgttacttaacctatgtctcagtttcttcatttaatttttttaaaaggtggggggaggggcggtgtggcagggataaacttttggtgtaaggtttaattgcagtagtgtacatgaaatgactagtgcagtgactagtgcactctttgtctgactggtgataccaaggtattaatatactgaaacttgagctgaaagggaaaaaatctgaggaataaggagaaaaataccaatattgaccttatttacacttctatatattatggaaaaacctggcttgcttggtagatggcagtggaatatttaatgctcttttctgtgtgtttaagtattgcaaatgatcatgaacttaatagaaagttaaagctcttttttgagcagctgaatgacagggtattttggcaacagagcatgtttccatgagcatgtttaccagtgtgctgaaggaaatagattttggacaacaggtccttctttaaattaaaaaaaaaaaaattctttatgacagaggtgtcattatgcttctaatagatgcaaggagagttacttgcctttttgaaacaataagaaaggaagaaatagttaatgtttgcagttgcacgaaagagtaaatgtggtaaatttcatgaagttaacacaaaaat

SEQ ID NO: 41114 - DNA, 940 bp, Homo sapiens
gaagtcattctgcactaatagcggcaaaaagccttctggttcctggggcgacgcgcccggcggccgtactattcacttccccagaacgccacagcccaggctttcttcttagtgggcttcccagaccaagaagggaaacctttcatccgaaggtactgaggggaggaaggtggcctgaagttatctcagtgccgctttgtttcccaccccagtcggtcagcccttcctcagcgccctttaacccttgcagatcggatggagaaagctgccagcacgttctagggatgggggcagattgaggagcgggagggagtagtctttgtctaactttataccagtaccaaactatgttaatttaatgtagttttataataaatctttaagtcctgtaacttattctcccaagattgtttggcttattctacggcctttgtatttctaggtgaattttggaattagcttgttaaaaaggggggggattttttattgggctcgcattgaatctatagatctgtttgggaaaactagtatcttaacaacaagtccttcaatccatgaatatcattcttcccccaccatttatttaagcggtctttaatttctcctggcaatattttgtagattgcacatatatctatattttaatgcagctgtgcttggatagattgcagtatagagatcatatatatctttcattagatttattcttgagtatttagtgttttgtatacaatgttaaatggcattttgacttttttatattctactcgtaagaataaacaatattgattttaacatactgaccttatatgcaagcatcttgctaagttcccttgttatttgtaatactctgtagattctttcggaatttctgtgatcaaaatcttgcaatccacgaataaagatggtttaacttctctgtaacctttataccttttat

SEQ ID NO: 41115 - DNA, 1584 bp, Homo sapiens
gcggaactgggcgaacccgggggttcgtttctgctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgcaaacaaaaaaaaaa

SEQ ID NO: 41116 - DNA, 1584 bp, Homo sapiens
gcggaactgggcgaacccgggggttcgtttctgctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattatggctgagacctccatgggctggtggtaggctggatcatcgctgggaaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgcaaacaaaaaaaaaa

SEQ ID NO: 41117 - DNA, 1662 bp, Homo sapiens
gcggaactgggcgaacccgggggttcgtttctgctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgagttttataaatttgtcataaaatgtggggatgtaggcagtctgaatgcacacgttttgatgcagtattatgacctgaaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgcaaacaaaaaaaaaa

SEQ ID NO: 41118 - DNA, 1623 bp, Homo sapiens
gcggaactgggcgaacccgggggttcgtttctgctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgagttctggaggctggaagtccaagatcaaggtcctgacaaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgcaaacaaaaaaaaaa

SEQ ID NO: 41119 - DNA, 1612 bp, Homo sapiens
  misc_feature (52)..(52): n is a, c, g, or t
  misc_feature (97)..(97): n is a, c, g, or t
ccgggggtacccccccggggtccgtttttttttccattttattttccgcccngggacatttacttttaccgttccccggataccccaaaagggcggnccaatacccccaattgggccaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgcaaacaaaaaaaaaa

SEQ ID NO: 41120 - DNA, 1470 bp, Homo sapiens
  misc_feature (52)..(52): n is a, c, g, or t
  misc_feature (97)..(97): n is a, c, g, or t
ccgggggtacccccccggggtccgtttttttttccattttattttccgcccngggacatttacttttaccgttccccggataccccaaaagggcggnccaatacccccaattgggccaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgcaaacaaaaaaaaaa

SEQ ID NO: 41121 - DNA, 2045 bp, Homo sapiens
gggtgtaatggacgaggctgccgtgctgctcggcggcgctgaggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaagcagtgcatgttcattttagagaaattgagacagaaaagtgggcaaaaaagaagcttctgtgatctctcccacttagaaaaaaaattcattgctgctgatttacgaatattttcgagacatactggagaggctaggaccactggcgagctaggaccactggcgaggctaggacactggcgaggctaggacactggcgaggctagga

SEQ ID NO: 41122 - DNA, 1925 bp, Homo sapiens
gggtgtaatggacgaggctgccgtgctgctcggcggcgctgaggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactggctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaagcagtgcatgttcattttagagaaattgagacagaaaagtgggcaaaaaagaagcttctgtgatctctcccacttagaaaaaaaattcattgctgctgatttacgaatattttcgagacatactggagaggctaggaccactggcgagctaggaccactggcgaggctaggacactggcgaggctaggacactggcgaggctagga

SEQ ID NO: 41123 - DNA, 2124 bp, Homo sapiens
gggtgtaatggacgaggctgccgtgctgctcggcggcgctgaggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaggatccacaccggggagaagccctacaagtgcagcgagtgtgggaaggccttccggcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaagcagtgcatgttcattttagagaaattgagacagaaaagtgggcaaaaaagaagcttctgtgatctctcccacttagaaaaaaaattcattgctgctgatttacgaatattttcgagacatactggagaggctaggaccactggcgagctaggaccactggcgaggctaggacactggcgaggctaggacactggcgaggctagga

SEQ ID NO: 41124 - DNA, 1909 bp, Homo sapiens
gggtgtaatggacgaggctgccgtgctgctcggcggcgctgaggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacgtacttgattcagcaccggaggatccacaccggggagaagccctacaagtgcagcgagtgtgggaaggccttccggcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttctt

SEQ ID NO: 41125 - DNA, 2139 bp, Homo sapiens
gccgaacgggcgaggttgggctgccgtgctgctcggcggcgctgagagacagggtttcaccgtcagccaggatggtctcgatctcctgacctcgccatccacccgcctcagccacccgaagtgttgggatttcaggggccaaatagttgcatcacatgtatctaatccgagagtctcatgcttctgctcctcagtgaccagctcctgctcactgccctcagaaagcccaaccctcaggcaatggcggccttgttcctgtctgccccaccccaggccgaggtgaccttcgaggacgtggctgtgtacctctcccgggaggaatggggccgcctgggccctgctcagaggggcctctacagggacgtgatgctggagacctacgggaacctagtctcactgggagtaggacctgcaggccccaagcctggagtgatctcgcagttggagcgaggggatgagccctgggtcctggatgttcagggcacctctgggaaagagcacctgagagtcaacagcccagctcttgggaccagaactgagtacaaggagttgacttcacaggagacatttggtgaggaagatccccagggatctgagccagtagaagcctgtgaccacatcagtaagtcagaggggagcctggaaaagctagtggagcagagaggccccagggcagtcacactgaccaacggggagagcagcagggagtctgggggaaacctcaggttgctgtcaagacctgttcctgatcagagacctcacaaatgtgatatatgtgagcaaagttttgaacagagatcatatctcaacaaccataagcgtgtacacaggtcaaaaaaaacaaatacagttcgtaactctggggaaatcttcagtgcaaacttagttgttaaagaagatcagaaaattcctactgggaaaaaattgcattattgcagttactgtgggaaaacattcaggtacagtgccaaccttgtcaagcatcagcggcttcacactgaagagaagccctacaaatgtgatgagtgtgggaaagccttcagccagagctgcgagttcatcaatcaccgaaggatgcactcaggagagattccctaccggtgtgacgagtgtgggaagacattcacccggaggcccaacctcatgaagcaccagaggattcacactggggagaaaccctacaagtgtggggagtgtgggaagcactttagcgcctactcttccctgatttatcaccagagaatccacaccggagagaaaccctataaatgtaatgactgcgggaaagccttcagtgatggctcaatccttatccgacatcgtcggactcacaccggagagaagccatttgagtgcaaggaatgtggcaaaggctttacacaaagttctaaccttatccaacatcagagaattcacactggagagaaaccctataaatgtaatgaatgtgagaaagctttcattcaaaaaaccaaactcgtggaacatcagagaagccacactggagagaagccctatgaatgcaatgactgtggcaaagttttcagccaaagcacacacctcatccagcaccagagaatccacacaggagagaagccctacaagtgcagcgagtgtgggaaggccttccacaacagttccagactcatccaccaccagaggctgcaccacggagagaaaccctacagatgcagcgattgcaagaaagccttcagccagagcacagttccaacatgtgtcagcatcagcggattcacctccgggaggacttctccatgtaacagtggcgcggtgtccgagggcagagtccagctgagcacttcctgcatgcgcccccggcacctgactctgccctttatgtattatccacacgatgttttcacagagtgaaaggacgtttctcattaaacaaacctcttttcttaaatcaaaagcagtgcatgttcattttagagaaattgagacagaaaagtgggcaaaaaagaagcttctgtgatctctcccacttagaaaaaaaattcattgctgctgatttacgaatattttcgagacatactggagaggctaggaccactggcgagctaggaccactggcgaggctaggacactggcgaggctaggacactggcgaggctagga

SEQ ID NO: 41126 - DNA, 496 bp, Homo sapiens
ggctactgtggcactacactttactgattctccacatacctttcttacttctcttttgtttttttcctgagtccctccagatgtggcctaggaatccttttaaacacagtgttccaggcagaaattagttggagttagttcacaagatgcaatttatttgccatccacccttgcatttcagctccattatttgtccttgacatgcttgtctataaaaacactttctccttcccagagatggcagctaacaatacctagcaaagagaaatgggaatttcattcacaatgtcatagggaaagcaattggtaaaattattttactgccaaggataataagattagagagttgaagaaagaggcatgaattctgaaattgtatagaaccatctaaaaggtaaagctgaggagttttatccatacttaacaggctgtgactgttttcatagaagtactctctgatttatgggcatgtcattgattacaactagaattgcag

SEQ ID NO: 41127 - DNA, 218 bp, Homo sapiens
cacagcaccctgagcatggtaaactttacttgctgaagaaaggcacaggtgaaactggctgtcttttcttttttgtttgctctgttttaataacacgatttttaaaaacataaattagaaaggacatacatggaaaatgtttgccttttcttactgctcagtctcactgggatccaggtaagggtatgtgtggtcagtgcaatttatccttactactg

SEQ ID NO: 41128 - DNA, 232 bp, Homo sapiens
ccttagctaggtcaccagcccagacagaagaagctgcttgtgcagaacttcctactgctcaggacaccagccacttcagcactctgccaacacttgtgtctggtcatactactaaacgaagtaagtcactcaattgttacctatctcagttgtaaaagagaaacagccctcagcttagtatcagacattgtttgattacagtgacttatgtgtaacagttccctgaaaaata

SEQ ID NO: 41129 - DNA, 345 bp, Homo sapiens
gagtagctggagtagcagggacggtagccaaatgccagcacacctggctgatttcttaaaaatatttttgtaggtcgggcgtggtggctcacgcctgtaatcccagcactttgggaggctggggcaggtggatcacctgaggtcaggagttcgagaccagcctgtccaacatggtgaaaccctgcctctactaaaaatacaagcaatcatcctgccttgacctccctaagtgctggagtgctgaaattacaggccttagctgggcatggtggcgcatgcctgtaatcccagctcttgggaggctgaggcaggagaattgcttgaacctgggaggtggaggttgca

SEQ ID NO: 41130 - DNA, 1056 bp, Homo sapiens
acaaagactagttagtctattaaaactgtgaatgtgtgtagcaattctgcttgtgaagggaaatacactatttaacatgaaattatactcctgacacaatatgctatatatacaaagacctcataactagtaaattttcaacatgtgagttcagtgactagtaagaatgaataaaaatgaagctcctttagttaatctacgcaagggaacatctatttatagttactaattaaaggactctgtaaagcaggaaaaccatgcagggtaagtgggtagggcagcaaactgttctgtggatttgggcctcatgacggtttaaaattgccttgcaatttgatctcaccagtggctgacatttgactatagtccatttgccagccaaggtaagtccctacccattgctctctgcagctggccccaagctcctgctggacaggaatgccttaaaggggacccacactgggaggcagttcagaaagagggaaaggcggaggaggtgtaagtaggacaaagaaaagtcaaactacagaggaatcataaagaaaataatagaataaattgagaacccaaggggatgggaaaaaatagcaagcaaggagagtgagaaagaagaaaaggtaatagtgtaagtagaaaaaactgttagtggaaggcaggttaaatttggaaggaaaaatagaacaaaaaagcaaagtaggagtgttggaatttacagcaatagagcaccacatcatctcttctgctcgataattttggaattgttggctgatgcattagcccagtggttttcaactgggggtagctcaccctcccactcaagagacagttagcaatgtctgcaaacattagggtatgctaggggtgctgctaaatatctgaaaatacacaagacagctccccacctccacgcggaattctctggtccaaaatgtcaagagcaaagagggtgacaaacttcattggcccattgtcagcaccgattccagactcccagtgactgtgcttcaattcgcccactgttttctgacctatatcatgttatactgcatatagatc

SEQ ID NO: 41131 - DNA, 371 bp, Homo sapiens
ccgcccagccagccctagaggaagtggccactgaggcaaagctgtgacctcaaaaatgtacttgtagagaggcacgtgtgcatgtgtgtgcatggatatgcatgttcccaggactttgcagtctgttagggcatctgtgaggtgagcggctatgtcagagcctgcctggaggaggaagccttctgtgggctgaaggctgcctgtgatcactgttattttccatggcagagaatgacgggtcattttcagaaaagtcgtcaaaggtcatcacaagagatcctacaagtatttcctttttgaagctcactgtttcctaaggtgcctctgcagctgttaactgtccttgcttgattaaagtttccaacaaccta

SEQ ID NO: 41132 - DNA, 448 bp, Homo sapiens
ttctctgttcagaatttagatctggtaacttacatgaaacacagcccctaaaccggaaagcatacaaacaagaaaacacaatcaaacatcccacacactaacacatattcattcaaagataaactcctcaatgtatcaatcactaaagaatcatgagacataattctgacaagtgttattctgatatccaatttcagagaaaactaaaagcagtcaattagaaggaaagtcttagttactaaaggaaggtgactcatgaaagccaacaaaaatgaagaaaacaataaaaagtcacagaacttagaaaagaacatagaaaagaaacagattataagaacataaaaaaccaagtagcccaaaataatttatcacaggaaaaaaacagacctattctggcaatgatgccagaaaagtattacttcataacctctgtcaaaaagatgaacct

SEQ ID NO: 41133 - DNA, 890 bp, Homo sapiens
agaaccatgggtgtgagtgggagggggccacggtgacagagtgacctgtgccccaggaggcctttgcatgaagtctttgtcagcagtccccagtgacccagctcggcaaacgctcaggaaggcaactggcaactgtgacctctaagtggggcaatgaaagaaaggaacccacatttccatgctcaggaaaacctcctgtagaagctcaatcatcataacctctggtggaccttcttgttcaaagtcacaatggattccttgccacgccctaaggtgatgaagagagactgtgcctgtaggtcacgtgctcatcggcaagccttcccttcttccttcacctatgccctgccacccattctcaaagagttgaagattatgcttgtccataaaactcagcttgtagagccagtctttcctaccaagataatatgttcattagctcctgacatcccctattcacagaaataaaaagatctttgccactctatactgactgctttgtgtgtggccttccaaaactggatgtcgttcatgggctagggcatgcaggcaatgtcaagctatcctcatctttgcccttggtgccagtgacttgcctgcataagctaaggcaaggggaccccagggagaaggtccaggacatgtcactatttgtggtttgtcatgccagcaagagaagagaagggctatgggcccatgctgagccacctgaaattctcagcagctgactaccaccgcttcttaactcacccccagatacaatcttagaataaatctgaagtccaataaggttttccagtcatcgatagatttaatggtcttgactttgtattttctggaagttggctccaaggtgttcagctacgttgatctcctggaggaaagttaaa

SEQ ID NO: 41134 - DNA, 401 bp, Homo sapiens
ataaaataattgatttttggccaggcgtggtggctcacacctgtaatcccagcactttgggaggccgagggggatggatcacttgaggacaggagtttgagaccagcctagccaatatggccaaaccccatctctactaaaaatacaaaaaaattagccaggcatggtggctggcacctatagtcccagctacttagaggctgaggtgggggaatcgcttgaacctgggaggtggaggctgcagtgagctgagattgtgtcactgcactccagtctgggcagtagagtgagactctgtcttaaaaataaataaataattgactttcatgagcatgaaggattctccagaaattgagttaggtgcagccgcatgctggtcagaacagtctagcaaagatggc

SEQ ID NO: 41135 - DNA, 1065 bp, Homo sapiens
aacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgccccagtgcccgtggcctatcgcctgttgcacgcgccgtcctacttccggcagccttgtggacgatcttgttgttcaatgcgggcatggaggccacacatgcttggtgttgagcgtcccccggggtcacccgggggtgactttgctggagcgcggggcgctatacgcatgcgccgaagccctgggcgttttgctagatggcactggggccctcctttagcgtgccaatggggtgaggggccttgctgctaggcctgtccattggtccgcgggaccttgactgacagacggtgaagggaggattgatcggaggaggatgtggacggattgagaccagattgtgggaacgatccggcgaaggtagggggcccagggcgagggcccgagtatcctacattgccttccagattgtggcatgctggctactacagtgagaggtcgtgacatggcctcagaggaagggcctgacccactggctggggcgctaacgttggtggccgagagagttgcaccggagggctggtaatgaggaggactcccgaagaggtatggttcccttggggggaaaggatggggcccaaggtgccatg

SEQ ID NO: 41136 - DNA, 1526 bp, Homo sapiens
aacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgtggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaa

SEQ ID NO: 41137 - DNA, 1922 bp, Homo sapiens
aacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgtggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaaaaaaaaaaaaaaaaaaaaaaaaaaaaaaaaaacaaaaaaaaaaaaaaaaaaaaaaacaaaaaaaaagaagggagggggcgcgcgcgcgccgccaagagagaaattctcctcgctgccggggggggcgcccccactcttgcgaggccgctcccccgccttttttgtggggagagggggggggccccccaccaatgtggggcggggggcgggccgtctatatattattataatacgccggcgggcgaggcggaggcggcgccgcggggggccgcggccgccgggcggccgcgtattatttatcatacaccgaaaccgaaaacaccgagcgccggcaaaaaagagagaaggagaaagaagggaggaaaaaggggggaagggcaggggcggggggggaaa

SEQ ID NO: 41138 - DNA, 2536 bp, Homo sapiens
aacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaaaaaaaaaaaaaaaaaaaaaaaaaaaaaaaaaacaaaaaaaaaaaaaaaaaaaaaaacaaaaaaaaagaagggagggggcgcgcgcgcgccgccaagagagaaattctcctcgctgccggggggggcgcccccactcttgcgaggccgctcccccgccttttttgtggggagagggggggggccccccaccaatgtggggcggggggcgggccgtctatatattattataatacgccggcgggcgaggcggaggcggcgccgcggggggccgcggccgccgggcggccgcgtattatttatcatacaccgaaaccgaaaacaccgagcgccggcaaaaaagagagaaggagaaagaagggaggaaaaaggggggaagggcaggggcggggggggaaa

SEQ ID NO: 41139 - DNA, 573 bp, Homo sapiens
aacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcctaaggagactcaagtggacccatcatatatgggggctgggcctcgggactctcgctctaataaaggactgtaggccatggggcctaaaccacgaa

SEQ ID NO: 41140 - DNA, 2140 bp, Homo sapiens
aacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaa

SEQ ID NO: 41141 - DNA, 2352 bp, Homo sapiens
gtggggcgcgggcaatggagcagagtatgggagaacgcgctcggagtaaagcacacggcgcggcgaaggcgtggcgggagtgtgcggcgccggacccgggaagctggcctgggcgccgggtctcgagtgcaggcctttgttctgaagtgtccaggccggccttgcggcgtcgggactgaggaatggagcccgtcgcggggcggggcgggaaaggaaggttcaagtctctcgggttgatgcgcaagtttccgtccccatcggccggacagattagaatcctttcaggtgctagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagagctcgctcaacgtgcacatgcgcactcaccggcccgagcgcgcgccctgccccgcctgcggcaaggtcttctcgcaccgcgcgctgctggagcgccacctggcggcgcaccctgcgccctgatggcgctggggcctggcctcgcccacggtggatccggggcctcccgcacagtcggccacgcccgctgcgggacccgtggttcccgccactagaccacgctccctcctgagcgcaggtcctctctctcccttcaccctttctccataccagggcctaagtccgccttactcctctcctccatgtacttgaaccctccaggtggtgccgggctggggctggggctggttagaccacttctgagaactggactatttcctgcgtaaaccgggcgctcaggcgcttggacccggcccaagatttgactccggttctcaccccgccctctcctggggtggtggtgggggctggggggccgcttgcctgccccagggtcaggctgggcaaggtccctagctctctacccaagctgttactccctcatggggcgcctaaggagactcaagtggacccatcatatatgggggctgggcctcgggactctcgctctaataaaggactgtaggccatggggcctaaaccacgaa

SEQ ID NO: 41142 - DNA, 1566 bp, Homo sapiens
aacggcccggaagtgcggccttgtagtcggtcaggaggaagcggccacggcagagcctggtgcctgaagaggagtcggagatggcggctgcagaggctgtgcatcacatacacctgcagaacttctcacgctctctgcttgagaccctcaatgggcagaggcttgggggacacttctgtgacgtgactgtgcgcattcgtgaagcttcgctgcgtgcccaccgctgcgtgctggcggccggctcacccttcttccaagacaagctgctgctcggccactctgagatccgtgtgcctccggtggtgcccgcgcagacagtgcgacagctggtagagttcctgtacagcggttcgctcgttgtggcgcagggtgaagccctgcaggtgctcacggccgcgtcagtgcttcgcatacagacagttatcgacgaatgcacgcagattatcgcccgcgctcgagccccgggcacctctgcgcccacgcccctgcccacccctgtgcccccgccactcgcacctgcgcagctgcgtcaccgcctgcgccacctgctggctgcacgtcccccggggcaccccggtgctgcacacagccgtaagcagcgccagcccgcgcgtttgcagctgccagcgcccccaacacctgccaaggctgaggggcctgatgctgacccctcactgtccgcggcccctgatgaccgaggtgacgaggatgacgaggaaagtgacgatgagaccgatggcgaggatggcgaaggtggcggcccaggcgagggccaggcacctccttccttcccagactgtgctgctggcttcctcactgctgctgctgacagcgcgtgcgaggagccccctgcacccactggcctcgctgactacagtggtgccgggagagattttcttcggggagctgggtcagctgaggacgtatttccagacagctatgtatccacttggcacgacgaggatggcgctgtccccgaaggctgtcccactgagacccctgtccagcccgactgcatactgtctggatcccgcccgcctggtgtgaagaccccagggccgcccgttgcactcttcccctttcacttgggtgcccctgggccacccgcaccacccccttcagcaccatcggggccagcccctgcgcccccacccgccttctaccccacactccagcccgaggcagcccccagtactcagctgggggaggtcccggctccctctgctgctcccaccacggccccctcaggcacccctgctcgcaccccaggtgctgagccacctacgtatgagtgcagccactgtcgcaagacgttcagctcccggaaaaactacaccaagcacatgttcatccactcgggggagaagccgcaccagtgcgccgtgtgctggcgatccttctctctacgcgactacctgctcaaacacatggtcacgcacaccggcgtgcgcgccttccagtgcgccgtctgcgccaagcgcttcacgcagaagtgcgcctgggtgcgcacccaggcgcacttctggggagtagtgtgattgaggtggagtagataaggcgtaggta

SEQ ID NO: 41143 - DNA, 183 bp, Homo sapiens
ggggtggggtgggggcggggagctgtagagtctgacttgcgttcgcggcccgccctgtcttccgcaggggagaagccgcaccagtgcgccgtgtgctggcgatccttctctctacgcgactacctgctcaaacacatggtcacgcacaccggcgtgcgcgccttccagtgcgccgtctgcgcc

SEQ ID NO: 41144 - DNA, 294 bp, Homo sapiens
ttgctagagatcaccatatcacatttagtcaaactaacataactatatgaatttaatattttagaataagtattataactaattctgtttcattggtaccacaactactactaatacttacattcattgaacagttactactaataattaacatttttaaacacctatgttgttctaagcactgtgctaaatgtattattttatttaatatctgcaacagactctaacaaacagatagtgattattctcattttacatgtttgtaaacagacatacatggaagttaggtaactt

SEQ ID NO: 41145 - DNA, 214 bp, Homo sapiens
aatgagtgaatccatgcaagccccataaaacagttcctagcatgcagaaaatgcccacgtaaatagctgtcatcatcattatcttttaacattttgggggactttccagttgaaaagaaaacatgctatgtcatttttatccattatccctggaacttattgtgaaagttgtgctgttttctaagtaaaataaaaaataaaaaattagcaattt

SEQ ID NO: 41146 - DNA, 356 bp, Homo sapiens
cttttggtactgatgtccaccaggctgtttcagaaagaagccagtgagcacccttccatcggccaccgtgcctagagctgttctccacattctctttttgcttatcctctcagcactcagtgggctgccagcctcaggatggtgttagattaaagaaatggcctatcagagcttagtaattcaccagttctctttaagaattcacatgaccttaaataaaatgttcgatttaacttaaaacaaatcatgtcaagcatgtaagcaaacaaattccgaaatggtgaactgtttctcttattttagattattttcttaaaatacccatctgtatttgtaatgaaggtctattctccttt

SEQ ID NO: 41147 - DNA, 469 bp, Homo sapiens
gacatgcaagtgcaggaccacatttttaaaaagtaaaaagaaacaggtaaaattagttttaatatctattaattagccccatgtatccatttcaatctgtgttactagccacatgttgagtggttacatacaggacattacaaggttaaggagtgaggcctgatcaggattttaaaatctccccttatgattatagtgtttaagaaccactggactagaatgaggagaggctagttggtgagagagagtttagaaagctgttttctgttgtctaagtgggagatgataatggcctggattaaagcatcagtgaaagggttggagagcaaatagatttgagagagatgtaaggaaaattgtcagggtttgatgaataaagtgtagatacaagggttgaagaaggaaaaagagttaagaattaaggttcctgctttagatattttgactgggttctatggtaccagagaca

SEQ ID NO: 41148 - DNA, 4717 bp, Homo sapiens
tgggttccaaggcggctggcggcggtagcgtctctgtttccttgtgggcgctcgcgcggccctgggtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctgtcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaaggagatggaataaactgagactgcaggacaaagagaaacgtctgaagctggaggacgattctgaggaaagtgatgctgaatttgacgaaggttttaaagtgccaggttttctgttcaaaaagctttttaagtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaaga

SEQ ID NO: 41149 - DNA, 4574 bp, Homo sapiens
cgcccaggtgcgcgcgtggcggagggggaacagagaagcaggacagctctccatccttcccgtgttcagtcgtgggagacaacaagagaggtcacagcctggcgaccaaaaagtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctgtcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaaggagatggaataaactgagactgcaggacaaagagaaacgtctgaagctggaggacgattctgaggaaagtgatgctgaatttgacgaaggttttaaagtgccaggttttctgttcaaaaagctttttaagtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaattgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaaga

SEQ ID NO: 41150 - DNA, 4348 bp, Homo sapiens
cgcccaggtgcgcgcgtggcggagggggaacagagaagcaggacagctctccatccttcccgtgttcagtcgtgggagacaacaagagaggtcacagcctggcgaccaaaaagtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctgtcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaaggagatggaataaactgagactgcaggacaaagagaaacgtctgaagctggaggacgattctgaggaaagtgatgctgaatttgacgaaggttttaaagtgccaggttttctgttcaaaaagctttttaagtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaattgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggtaatatagataacctttttgctttccagggtgagacttgcttgattgaatgctgtgaaaatttcacctgattctggatgtgaagaaaatggtcatctctggtgtaatgacacctgatatttgtgttgcacgctctgatttacgatgcacattcacttgaatctaaaaggacctgctgatttcctaaagacaaagtctttaacccaagatccgtagcagcatttctgttttgccattagaaggttgacacagggataggtgtgtcgctgctaggacagcctgccttgtctagagggaaagtgccagctccagagaccacaaccctctgaaataaaagtccagaaaactgc

SEQ ID NO: 41151 - DNA, 259 bp, Homo sapiens
ctggttaatttttcttatttattatcagaactcaagaagatacgttgtccctttttagtaaattaatacttggaaacttgaatttatgtagttggaagattattacttgatcttttgagaaatcagtctgctctaattataaaatatttaagaactacaatgaatcctatataacgaaaaggcttataaatttttttccttttaggtagtctgtagagaatgccaaatgagggaatcccccactcaagtcaaactcagg

SEQ ID NO: 41152 - DNA, 429 bp, Homo sapiens
gatgactttttcccaagttctggggaagaagctgaagctgcttctgtaggagaaggaggaggaggaggtcggaaagtgggaagataccgagatgatggagatgaagattattataagcagcggttaaggtcggtctgtggggattataaatacattgtactgtttgctttatcttaggtgacaggtttattaatatgtaagcattctagatccagcttaatatattagacccccccgattatacagaggttggatttctgcagccttaacctgctagaagcagtggggcccctgagtccttaatgatgctggccccaaatgcatgtacttctaggtctttagttggatttggaggcaagtctaagatgaaaaacttaagggaaggctggggcaagaggcatacagagggctgagtgtgagctgtgtcgc

SEQ ID NO: 41153 - DNA, 532 bp, Homo sapiens
tctatagtattcagcttcaacaataagaaaaaattctttctcattttttcatctaaatgtaattaaggatttgtaattgcataaaatgtgtatgttttggagagtaccaaaatgatgcaagaatgatgagtaaatgtgtaaataatttgcagaggagcgttttagggtaggaatggcgattgctaaaaggtaaatttaataaaaaggtgcttcctttcctcaaatagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtaaaatattaggatgataatacttttggcattttaatatttaaagtgctcctattaaatactataatttgtagccaagtcattcagaatgtgagaaagatggccaggctcataaattggtatctggt

SEQ ID NO: 41154 - DNA, 2210 bp, Homo sapiens
cgcccaggtgcgcgcgtggcggagggggaacagagaagcaggacagctctccatccttcccgtgttcagtcgtgggagacaacaagagaggtcacagcctggcgaccaaaaagtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctgtcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaagtcccaagatgcctcgaacactaagtttacatgaaataactgaccttttagagacagatgacagcatagaagcaagtgctatagtgatacaaccacctgaaaatgctacagcacctgtttctgatgaggaatcaggagatgaagaaggtggaacaataaataatctgccaggttctttgttgcacacagctgcgtatcttattcaagatggctctgatgctgagtctgactcagatgatccctcatacgcacctaaagatgactctcctgatgaagttccatctacgtttactgtgcagcaacctccaccatcaaggaggaggaaaatgacaaaaattctttgcaaatggaaaaaagccgacctaactgtacaacccgtagcaggtagagttacagcaccaccaaacgatttcttcaccgtaatgagaactcccacagaaattcttgaactttttcttgatgacgaggtcattgaactcattgtcaagtactccaacttatatgcttgcagtaaaggtgtacatcttggcttgactagctctgaattcaaatgttttctgggaattatttttctgagtggttatgtctcagttcctagaaggcgtatgttttgggaacaaagaacagatgtgcataatgtactggttagtgctgccatgagacgtgaccggtttgaaactatattttc

SEQ ID NO: 41155 - DNA, 991 bp, Homo sapiens
ttgtcttactcattctgaatctctaccagctgctcccagagtcacagatactcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaaga

SEQ ID NO: 41156 - DNA, 904 bp, Homo sapiens
  misc_feature (843)..(843): n is a, c, g, or t
  misc_feature (869)..(869): n is a, c, g, or t
gtttagccttagatagagaagcaactgccttctttccttatattcggagatataagtagaggtgggtttgtggacttggaaactcaagtgagctcccttttgatgactctctaggaggcagagtcatctggtgagaatgcagtaggaagaagtagggtatcagagatttgaagagaggaaataggggtttgaatagtcacaagaatggggaagaatgttgaccagggaaggatgttccatggatttagagtggcaccatttagcctagtatgtgaatttcttccccccgtccagcagtgttcagtagtctgagcccagattgtaccatcagctctttgaggatatatattctaacgtatttgttgaattattttataacacacattagtgatgtttaaaaaaaaaaaactcaatgcattccagattttgtcagtttctcacactcaagttaaaaagataaaccaaaatataccaaaggaagacattttctttaacattatgtggtaccttaagacatgagtgaataaagatgtaattaaggaaaatcagttggaatacttaaatagacttagttgtaaaaataaaaaaaaatgtgcttgttgaacgtataaaagcaaaataagtaataatactcggaacttcccagagaccctaaggttgctttagtaacattcctctccagccagatgagtactaagagttgattccaggttctcatgtttctcttgagccttttagtgtacagctattaagaaagtacaaataaactaatcaaaaactcgtgggttttttttgtttatttttggaggcagagtctcgctctatcccccaggctggaggttncggtgagccgagatcgctccattgtnttccggcctgggcaacaagaatgaaactctgtctc

SEQ ID NO: 41157 - DNA, 630 bp, Homo sapiens
aaaattggctcaagaactaggtgatacattttagaaaattttaaatagccaaaataatgttgaaatatgttatatggataatttatcaataaaaattattactgttaaaaattggtagaattctttcctccctgtgataaatgatttaagttgaatgggaatttaagtaacatacagggatgcatcttaatacctatatttgctcaacagtggtaaacacacaattaaaacttgtcctcattaaaatggacttttgtacactataatttgaagtaagtaatgaatatataaagtatttaaagagttgtatatcaaaatgtataacgttccatttttggctatattttgtaaaacatttttggtgtaatcagtatgactatcacatatgtcaaatcaagtattctactatttatttaaacggatatatacctaatgtatttgaaagcttattgcactcataaaattgtatatattgtggcttcaaaagtctgtacttattcttgctttaaaaaagtagtatgtgcatttctttccaatttatttttaattaattatattaaggataacattctttactaaatgtaccttaaaattcacaataaagtttcagaaattgttttgtacagtgtt

SEQ ID NO: 41158 - DNA, 631 bp, Homo sapiens
  misc_feature (248)..(249): n is a, c, g, or t
  misc_feature (256)..(256): n is a, c, g, or t
  misc_feature (259)..(259): n is a, c, g, or t
  misc_feature (330)..(330): n is a, c, g, or t
  misc_feature (355)..(355): n is a, c, g, or t
  misc_feature (361)..(361): n is a, c, g, or t
aaaattggctcaagaactaggtgatacattttagaaaattttaaatagccaaaataatgttgaaatatgttatatggataatttatcaataaaaattattactgttaaaaattggtagaattctttcctccctgtgataaatgatttaagttgaatgggaatttaagtaacatacagggatgcatcttaatacctatatttgctcaacagtggtaaacacacaattaaaacggggccgcaggaaaagnnacggggnganaagagaagggcaacgaacgaagcaagagagaaacgagggaaacacggcgagagaaaaagcgagaaacgganagggggcccgtagaggggcgaaaanagggtngggggaatcagtatgactatcacatatgtcaaatcaagtattctactatttatttaaacggatatatacctaatgtatttgaaagcttattgcactcataaaattgtatatattgtggcttcaaaagtctgtacttattcttgctttaaaaaagtagtatgtgcatttctttccaatttatttttaattaattatattaaggataacattctttactaaatgtaccttaaaattcacaataaagtttcagaaattgttttgtacagtgtt

SEQ ID NO: 41159 - DNA, 945 bp, Homo sapiens
cctcagctggtgctgcactctctgggcctcagtttcccacttgggcctcagctggtaatggcacccacctccgagggctgtcagggagaggaagggagagaatctgtctttgcactttgttctctgcccaggggagctctgttatgcccattttactgaagacgagactgaggctctgagcggcaggtgaggcctatagcccagcagcgcctttttcctcccctcctggtggctcaggtgtcgggagacagttcgcccggcacccccgcaccccatagccccgccttctcagatgctgttctagaggcctccctgctccctgagctgaacaaaggtgactttaatctccgtagccttgggctgggtttttagggcaccaccaaatctcgggagaacaggcctcccttgatctcattaagaaagcattttccttttaacccagcggcgcagtggagcgtctgcaggggctggccctccgcctcccacggcattcctgggctgagattctggggaggcctaggggctgggtgcgagtctgtgcgtgtggctgccctggggtgtctatgggtgctgcaggaggggtgcatgcatggagaggcggagacccagcctgccacccccttagctctgggcctcaccctagtgagcatgtgcccagggctgggtcaggctggataaggatctgagactaccaaggtgttccagggcctctgcgggacctgtgtgtacagggaaggaaactgaggctgggtgggcatcagggggttgtcccttggtcagagcattgcccgtacaccctgggttttgcactcagccatgccagggtgcgccgggcggcacgcgctgggcgggccgggcagaggaaggaacattcctccccgtgtgccggcaggcccaggcgggcgccggcgactcctggccccgccctggcggccccctcctctt

SEQ ID NO: 41160 - DNA, 347 bp, Homo sapiens
gtattctttttaaacttttccagagacatcacttatgtgatcttacttggtttctacaacattcccagccccaggaggcaggcagagtgatattgccaatcacatttttgtagacacaggctcagagaagtgacattacctgctagatgtcacacagcccatctgggaccccagggctcaagcccctgccctctggccctgagtcctgcctctgtctgtggactcccagctcttgctgttgctagagtgtgctgctcctttacttggcatgtccacattcctgggttgtccaggaacgcacattcttggagaggaaggggaatagatattttagccacatacaacac

SEQ ID NO: 41161 - DNA, 268 bp, Homo sapiens
gtggaacaagcatgaactttctgttcaaacgcactgcacagaacgagcctcagtcttctcacatttaaagcagtcagattcattagacttgagagacagtctctgagttcctctgctactcaaatttttatttatccttagtcattctcacaggacaaaggctgcaggaaccttctggtagaaagaaacaaagacaggagaaatcaacagagacagaaatggaacagtagcaaaaaggaagctgtcccagatccaggcaagaaagatg

SEQ ID NO: 41162 - DNA, 330 bp, Homo sapiens
tgaaggaaggaagggaaatagatttatgttaatgattcctgttcgactaaaggactgggaattttgcaagtattcaagggcaaaaagacctgtgttacaggtttatgactgggaaatgtagaatttccatctggatttttgaaaagctgggaatcatgaggctttcccggattctgtctggtttcaggacactgggatggggaccactggcttaagtcaaaggagaggaagtgattatgctgtggtggggtgtacacctcagcccggatttcgggaggctggaaggcctctgagaccatttccagctctatcattctatgcaaaaaaaaa

SEQ ID NO: 41163 - DNA, 929 bp, Homo sapiens
tgaaggaaggaagggaaatagatttatgttaatgattcctgttcgactaaaggactgggaattttgcaagtattcaagggcaaaaagacctgtggttacagctgtatccagctccagtccagggaaaccgtgggaagtagagctgggccttgagcagtcccagagcccaccttcgatggtggtgcttgctttggtccaccttgtctcttccatttccctccagggtccagtgtcatcctgatgcacctgcccctgcctccaagcaccttctatgaaaggcctgcagaagcccttccctcccaggtccacctgcctacccagcaaaccaattttggagcctggatgatgatagataagaaggagttaatccaacacctctcccaggcaactcatttccatgtcagaggcctggggtgagggtggtgggtggaggactcatggctcccacccatttcattaccaaggattcctttcattatttatcccctttcatcattcccaccttctgctttgaaaggttctgtatatcaaacaaacagtattcattaagaattgatttatttgttttgccattttgtaaattaagtcatcaaagctggctagagctgtaagtccacactcctgatcagcagagataagacctgctgtgtgctgagtggaagtaattgtattcccgagcaaagaaacctatagttacaggtttatgactgggaaatgtagaatttccatctggatttttgaaaagctgggaatcatgaggctttcccggattctgtctggtttcaggacactgggatggggaccactggcttaagtcaaaggagaggaagtgattatgctgtggtggggtgtacacctcagcccggatttcgggaggctggaaggcctctgagaccatttccagctctatcattctatgcaaaaaaaaa

SEQ ID NO: 41164 - DNA, 517 bp, Homo sapiens
cagaatttttgaaaagtaattattttgaaaaatgaatggcatgcagctagcctttgtataaaaataattttctagatttgaaccctaatagttaaaaattaaaaattaaacataaacatactgcttttaattgtcaggtatatatataagatagagctgaaactgtggtttaggtctttctgtggaatgccattacatctttatattagtcaagtccatgaaaataaatgtttagatcgtcttgaattgttagtctcaggcagtgttatcctgctctcaggccaacagggggagcaaaatagaaacattccagatatagctttcatttttgagaacttgagtaatcagaatttactgttctgtaaagaataaaggaaaggaaaattataaagagagaaatttctttttaaagccctcacagaatgtgctagaaatagaataaaatttaaaatacttttggcttcttttcctcagcttaagttcaaaataaaagcaatcctttacagttaaaaaaaaa

SEQ ID NO: 41165 - DNA, 385 bp, Homo sapiens
aattttaattggcagaagcagtgctgactgggaccccagacagccatctgagaccactataactttcctcactattgcctgtctctgttctggtagatgctgggttgtgtgttagatgttattttgcttttagaaaaaaagaaaagagaaaagcacctgaaattatctcttcttgcattcattcattcattcatgaaatactgattgagtgcatattgacaggcaaagatctgtgctagtagccgtagtgatcagagccaggcccagggtaaggcaagtggggcactcatcccaggggcatcatttaaggggacacacacaaaaaaacaggaatcaaggtaaataataccttaatgcaatatttcaagaagtcaaaagtaatgcc

SEQ ID NO: 41166 - DNA, 291 bp, Homo sapiens
tgtgatttaatgtatgcaacacctattctaggacaggcaaagtacaaagtgccttacacttaatctcccataattacttcctgaacatggattgttctcactgtgttcagatgtcataactgcacctgagcgttacagagccaacaaatgttggaactgggattcaaaggagatctggtcactccaaaggccatgctcttagtctctagtagtcaagataacacatttgagaattctgtagataaatatttaaagacatttttagcaattgttgcatgcttgtttctcacc

SEQ ID NO: 41167 - DNA, 539 bp, Homo sapiens
attctgtcagaagaatgccagatattataaaaagccccagtaaaagactttcccccccaaagatggaaaaatactcagtattggtaaatgtatggtgaaagagttgttcccgtgtatcgttagctgatatgtaaaatggtactacatttttaaagacaacatggcattttgcatttagtttaaaacacggccaagcactgtgttttatgcctctttgggaggctgaggcgggcagatcgcttgagccccaggagtttgagacccacatgggcaacatggtaaaaccccatctctacaaaaaacacagaaattagctgggccaggtacattggctcacacctataatcccagcactttgggaggccgaggcaggcggatcacctgaggtcaggagttcaagaccatcctgggcaacaccgtgaaacctcgtttctatgaaaaatacaaaaattagctaggggtggtggcacacacctgtaatcccagctactcgggaggctgaggcaagagaatcgcttgaacctgaaagacggaggttg

SEQ ID NO: 41168 - DNA, 361 bp, Homo sapiens
ggggctccaatttccgtcaaaacataaactaatctacataaacaaaaaaaaaaatcgctaaaatagcaagtatttctatgaataattcaccgtaaacactaaatcagtagtatcaggatgctaatttttagtgtcatatttgcgttaataaataggcacagtcttcaatcacaagtttcttctacatgtaaactaagagttaagaaagaaaaatagttaaggaaagacaagttaaaggaaacaatcagagaacaaaccagaaaaaggtaaaatatattttatttgggaacaaatagagctatctcatattacaaatagtccctattttacattacaaacaaaaattaattccagatggatt

SEQ ID NO: 41169 - DNA, 320 bp, Homo sapiens
ggtgaaaaagcttcttatgagggcatttttaaagtttatgtaactagcatattttagcattcagtagaagaaaatactctcaccttgctggaattatttctacagaaaaggaaaagattatgttaaccctgggtcattaagagcttcctagtacttagtaatgagtgggcttcatttccataacacaacattttggacaggaatatggcaagtatgtaatcctttttgcccttaatagcctaaacccagatctaccatggatttgttgtaattcaagatttgtgtgtatcttttaaagaggaaataatattttggaggga

SEQ ID NO: 41170 - DNA, 1887 bp, Homo sapiens
agtagagacagggtttcaccatgttgaccaggttggtcttgaacccctgagctcaagtaatcctcccacctcatcttcctaagtagctgggaccacagacacacagacatgcaccactaacccagttcatgatagacccttggactttactgttatggaaaatgtatataaagaaatatcagtgtgtcaaagccttatgtctgtcacaagctggtgaaagaaaaataaaaattactaagccaaagagaaaagtcaagctgggaactgtgtcagacaaacttgcctcccgttttattcctaaacaagatagctacaaggatttttaaaaagttagaggctgggtgcagttgatcacctgaggtcgggagttcgagaccagcctgaccgacatggagatacccggtctttactaaaaatacaaaattagccaggcgtggtggtgcctgcctataatcccagctactcaagaggctgaggcaggagaatcgcttgaacccaagaggcgaaggttgcagtgagccgagattgggccactgcactccagcttgggcaagagcaaaactgtctcaaaaaaaaaaaaaaaaaaaaaaaaaaaagctacaatactcccctcacaaactggaagcctcaagctcttcaccctaaaatagttctgttgaattttaccctggcaatgtaaactgatagcttatctgcacaggtgtgggacagaacccgtccctctgtacacctgagtcaaatgcctatctgactgcttcccctgccctatttatgtaaaaattcagagtcaatgagccagattaaggcataagtgactattcctctactccctctcatatataaattgtgtattcagtgaaaggctgatgagtcactcaaagaatgtgataatttattatctacctgtgacccggaagccccccaattccagtttttccacctttccagaccgaattaatgtacatcttatatgtattgattgatgtctcatgtctctgtaaaatatgtaaaaccaaactgcagcctgaaaaccttgggcacctgtggtcgggaccgcctgaggctgtgtcacaggtgcatttttaaccttggcaaaggagatttctaaattgattgagacctgttagatacttttggttcacaagctcatgaacacagaaaaaaaagaataggaaaaaaactagcacaaaatcagttccaaaatgatcgagatgccgccattgcactccagcctgggcaacaagagagaaactccatctcaaaaaacagtaaaagaaaagaaaagaactaagtgtaatggaaagcacgaaatcagttccaaaatctgaactccttcatatttattcaacatagggaaatgctcttcaactttgtgtgcttagattccatttatgaatgatatatttctaatatttgattaaaataaaaacccatgctatgtaattttagccaatttaaagctgcaaataataaatgatcaattatatacatacgtgaaacttcctaatatttcacttagtattgctattgctatgttcttgaggcagacgctcagtctgtcagatagatacattaccagagcttggtgtcttccatatttctgcttaggactctgtggaccatgagtgtataaacttaagcaggaacctaggagagctagagcgtgggggcggtgcctggaacaagactggggcggggcaagagggaggaggccgcctgggggccaggccatacaatgggaaagggcagaaccagagggttatcgtcatcttgggggcggggtctggagggggtgttgttctgaagggtgggggccggcaagggtcgggttcgggctctctcctcagctgggccccagatgtcgcctgctgtcatcctcttgcccgc

SEQ ID NO: 41171 - DNA, 618 bp, Homo sapiens
ctggagacagattcattccagtttgtttcataacttaggtggcagaatggcacttttccctggccacttctttccttcttccccttctaggaggaaatcttaggtaggagagggaaagggactaaggctgtctgtacacaatgagctacgttttgggaagaggagcttagtgttttaacaaaagaaaggtttgtctgtgttgtagagatatgacttggtccactgcctatgtttgtaaataaagttttattgggacatagccacactcatttatttatgtattgtctgttttcacactacaaaggcagagttgggtagttgtgacagagaccacgtaatctgcaaagcctaaaattgttttactatctagccctttacagaacatatttgtcaaccccctcttgcagaggtttcttctgagctgcttgaaggaaaccttgacggaatcagtggacaggaaggacagtgggaggtgaacagtgtggtgaaatgcctgcgggttcctgtggagtccacagaaaggaaaccacagagaggcgagattccatattgcccatttcagttgggttcagtatggattttgagaaattattctatttaaaataaataaatatttta

SEQ ID NO: 41172 - DNA, 201 bp, Homo sapiens
cttgaatttatcaaactgagtacatggtcatccagagagataaagatcattccagccccaaccctagtccccttgtttttaacatcaagtctggccatagaaagggtgaaggaatgaaatagaagaagaggtggcttcctagcttccttctttccccacacacccacatctaacgttctcttcacccaccgctattctctc

SEQ ID NO: 41173 - DNA, 375 bp, Homo sapiens
agcgtggctgtaatccttggactttagggggccatggcgggtggatcacttgagctcaggaattcgagaccagcctgggcaacatggcaaaaccctggctctacaaaaattagccagatgtgatggtgcgtgcctgtagtcccagttacctgggaggctgagatggaaggaccccctgagctcgggaggttgtggatgcagtgagctgagatcgagctactgcactctagcctgtgtgacagagtgataccctgtctcaaaaaatatatatatattttgtcaccaaggtaaatgtgtctgtaattttaaaattagattctttattttataatttaaaaaatagtataagtatatacttttattattgctcttata

SEQ ID NO: 41174 - DNA, 329 bp, Homo sapiens
tcttaatagagatggggttttgtcatgttgctcaggctggtcttgaaaccctgggctcgagtgatctcgccttggcatcccaaagtgtcagccactgtgctcggccatatatattaaagttattctgaaatatttattttaaaacaattttgctagtttacttagagcatcccaattcctttaatgttattttaacatgtatttgcacaagactatctaaaggaaccaccactgaaaaaaagtatatgcaagattccattgagcttctatgaatagttactaaaaagtatatttctgcctgaacaagaggggtacagactacaatttgc

SEQ ID NO: 41175 - DNA, 511 bp, Homo sapiens
tctggtgtgataggcacaagagtaacaaagatgactaagatgcagtctgccctttaagggatggtcagagactgatatgtgtttaccaaaatcgtttactcttctgcctgggtccatagtacatttccagtctcccttgcaggtcagtgtggcatgtgactgaagtctggtcaatggcatgtggacataaatagtatgtgatttccagtcctcacccataagaaacaatcctcatgcaatcctctagtagcttttctttttctgtccgttgcctggaaactaaggactccaaggtcttaggggatagcaaagccataatataaaaggagtttgggttcctgaataattgagtagaaggccaacagctgaacacgtgaatggacttgacatgaacgagaaataagcctgaactatgtttagttactgagatgttttactttatctcttacagcagctactgctgtcttaaggttatattcttcagtcaatagcatacgatgattcttagcac

SEQ ID NO: 41176 - DNA, 390 bp, Homo sapiens
gcgacagtggttaaaattgtgggtgctggagtcaagagagcacccgatgcaaaccctggccctgctgcttagtagccacaagaccttgacgagttcacctctctaggcctcagttgcctcatctctaaactggggataataaccgagcctgctgcgggcattcattgtgagaatcaagtgagacaatgaccacagcataccgagcacggcacctggcacacagtaagggcctcctaactggaagccattgtcatcactggcgcatcctggagatagcatcacaagtgccagttcttgcactgtgtcaccaagaggcctggtgcgcagcgggagactcagggaggaaggtatttttcagttccttcctggaaggcaattacaaacccagga

SEQ ID NO: 41177 - DNA, 978 bp, Homo sapiens
ttttctttctttttctttttaattttgagacggagttttgctcttattgcccaggcggaggttgcagtgagctgagatttgcgccactgcactccagcccgggaaaaaagaaaaaaaaagaaaatgcagttttgaaataacaatgatagtaataataataatcataaataacatattgagtgcctactgtgtgcagaccccgtgctggctgctagacactggaggagaggcattctttacatgagaggtatttgattttctccctcatcactgggtagggagagccttcttgtgcccgtttacagatgggaaacttgaggtccagagaagtgcagtgacttgccctgggtcacattactttttttttcttttttttatttttatatactttaagttctggggtaacacgttcatgtgcagaatgtgcaggtttgttacataggtatatacatgccatggtggtttgctgcacccatcaacccatgatctacattaggtatttttcctaatgctatccctcccctagccccctacaccacatactcttaatggtgaaaaccacagttacttttgcaccaacctgatattatgaggaagaactgggattacaccccaagtttgatgccaggactatagccaaagcccttgaccttctacccccaggagcccccaccctaagcaacgccctgtgctgagcactgagagtaggcagagggcaaggagcaccaggccctgaattcaaagggctcccggtccatgtgggacccatggaagaagcatatagtgctttgcgcttgttttttgcaatccatcagatccaacttttatttttattattatttttttaagagccacctcttaaaagatctcgctctgtctctcactgcagccttgagctcatgggctcaagcaatcctcccaccttagcctcctaagtccctgggactacatgtgtgtgccactgctaattaaaaaaaa

SEQ ID NO: 41178 - DNA, 433 bp, Homo sapiens
gccaggaaccccccagggctaagccccaatttgggggcttgcttatcctgtatcacaatctattctagacagattgtagatgtaaatagtaaagatgtttttagaaaagttttctcttttgttttcaattgagttagtttctgctctcatatggtttttctgtttgttttttggtggtttttgttttgttttgttttgttttgtttttgagacagggtcttgctctgttgcccaggctggagtgcgatggcacgatctcagctcactgcaactgccgcctcctgggttccagtgattctcctgcctcagccacctgagtagctggggttataggagtgtgccatcgtgcccaactaacttggggtttttttttgtttttgtttaagacagagtctcactctgttgcccaggctggagtgcagtggcacaatct

SEQ ID NO: 41179 - DNA, 278 bp, Homo sapiens
tggaaggctcaaaatagaaaaattattaatcatccctaaattgatatgcaggtttaatgcaattcctatcaaaatcccagcaagactatttgtagagcgagaagataattctaaaatttgtgtggaaaggcaaaagaactagaagaatatttaaacaaagtaaaagcaattactctacctaattttatgacttattacatagtctgacatagtaatcaagaccatgtggtaatggtgggagacagaaacactgatcaatggaacagaacagaggaccc

SEQ ID NO: 41180 - DNA, 878 bp, Homo sapiens
ttgtctatgcatatgatacctgtataagttttacaaaatgagaactaatacaatatttattgcctgcaatttgctttgtttttatttatattttcagtaaatggttattcagcgtctgcttacacatctatctatagagaacaagagctacataattgcaaaaatagtcctttccgttgtcattgtttacgctcattgtagttgattttagaatgtcttctccatttgttttaaatcttcctcactctatttgcatccatttgtcctatttctgtcccctggaacaacacagataaatctaatccctttaccacataacagactttaaacatgaaaagtaagccctcacttctctctgactgtcttcttcttctagttaaacaatgtcagggtttttttaatccatcttctcattcatcattacttctggatcattggccatcctaatagcagcacctgccagctctttggcctctcttacccctcgagacctccctcagttccatccctcacctcttttggtgcaaacacatttctccccaacttctactgaagtttttattctgttttcatttctctcctcagctacactagcatttcctctaagaactgaaacaagacaaggatgcccactcttaacattcttattcaacacagtaatggaagtcctagcccaagcaactaggcaagacaaagaaataaaggacatccaaattggaaaggaggaagtcaaattgttcctgtttgcagatgacatgattttatatacagaaaaatctaatgactctaccaaaaaactcagagctaataacaaattctgtaaagttgcagaatacgatatcaatatacaaaaatcagtagtatttctatacatgaac

SEQ ID NO: 41181 - DNA, 530 bp, Homo sapiens
ttgtctatgcatatgatacctgtataagttttacaaaatgagaactaatacaatatttattgcctgcaatttgctttgtttttatttatattttcagtaaatggttattcagcgtctgcttacacatctatctatagagaacaagagctacataattgcaaaaatagtcctttccgttgtcattgtttacgctcattgtagttgattttagaatgtcttctccatttgttttaaatcttcctcactctatttgcatccatttgtcctatttctgtcccctggaacaacacagataaatctaatccctttaccacataacagactttaaacatgaaaagtaagccctcacttctctctgactgtcttcttcttctagttaaacaatgtcagggtttttttaatccatcttctcattcatcattacttctggatcattaacacactaccatacatcgcaacacttaaaacacatactggcctatcctctaacatcagcaagcgggcgccacctacaaaacacaacctctcac

SEQ ID NO: 41182 - DNA, 222 bp, Homo sapiens
atcaataatatcttacatgtttaaagtaaaatacacaacaataaaaaccatataaacaaggaggggaatgattaaagtcaaaacaatatacaatcttgtattgtccaggaggagggtaaagatgccaattaaagttaaataaacatgcaaaaatttctcagaaactgttgatttgtatgggcatagtttgttttattgcacttcaaagatactgctttaaaa

SEQ ID NO: 41183 - DNA, 404 bp, Homo sapiens
cggtcatcctgtgctcggtggtgcacttagccacaggccctgtgcagagaggcgggagggagcacatagttgtcaaatagacatacccagaaacttaatatagagtgaccttactgcttattaggagccctacatagaataagtaatgtaaagggggggtgtgctttttaatttttatattttttacttgttgtattcaagaacgtatgtgaatttgtatagtagaattatatcacatgcatttaactatacaagaatgcagcttcatacccaattgactaaaagagttaaaaaaaaggcagacaatacgcaaaagtaccactagatttccaaattttaaaggctgtatgatacatttgctatttatgcttagtttagaactagtatgtccagaaattttgctg

SEQ ID NO: 41184 - DNA, 244 bp, Homo sapiens
ggcacgagaaaaagtatggttttcatttcatgaatggcgagtctgaagttcagagaggcttaccacatgtctaagaccacataccttccatcagttcttctatgctcccttttcacattctcagatctctgaaatcaggatgctttttacaattggcagtgtcttacaatcaagtggaagtatttttctgtttttagtggtatataaaataatgtatcttatattagcttagattcaatgaaat

SEQ ID NO: 41185 - DNA, 477 bp, Homo sapiens
gtacctcagaatatgactatatttgatgataggggcttgagagaggtgatgaagttaatcatgtctttgatcttggatttccagcctgcagaactgtgagaaaataaatttctgttatttaagccagctagtctgtggtattttgttatgtcaggcctagcaaactaatagatgccccaaagtgacaattctggaaacattagactggtcaatttacagcggattaaagtgtacaccaagtgtcagtttaataatttacattgggattacattgggattatttactgggattccaggcgtgagccactgcacttggcccaaaatttataggctggatgttctaaaactgttatgttgctactctttctgaaaaatatatctgtttagtggtagaaggctaaaatttctttgctgtttaacttgaagctaatttgttctctttcaagacacattttattaaaggaaagtgaagagaag

SEQ ID NO: 41186 - DNA, 328 bp, Homo sapiens
acaaattgcagcccatttcatttgttcttcacaagctggaacttttcttgtaagctaaatattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttataatttctcatgggagttgtggtttgtcacaaggttatggcggtccaagcaagtttacaatat

SEQ ID NO: 41187 - DNA, 1047 bp, Homo sapiens
gcatgacttcattggcgtcagcaacgttttgctgttcgggtttagccgccatgtttaagttggccgggtttcgcaccactgaggtcatggatactcaggcctctttgcgtgtttcttcaacactgcttctaaggttaaccgcgttacatttgttggagaaaatcctgggaacgctgaaaaggactagtgggtggggtgcgagggtggggtcttgcccgaattaaagatggccgcagtcagctctgccccgcgcaatttcacgtcaacttttggagctgcgggagccggccagttggcctcagcgcctccttacggaattggcgtaaggcaaagaggcgcggctggaagaaccagactgagaaagtgccacagggcgggggccgcatccgcccctcggcttctggttactgacccgacggctttgtgagtgaaagtgaagagacacttcgaggcaggtgtctgtgctccccattcatccctgtttccgtggctatcttgactttcggggtgaaaagtgaggttaggccctgtttccccgacccttccctcgcgccatcacactctagtggcctggcacagccccagaggtcggccgctgtagcccccattgcggactcgccacattcatattggctcaccttgtcggtgcccggttcggtcctcttggagctcacactccagttgaggaaatgaatggacacaggaactactgggtaacaaaatactaataaagggctgcgattgtgtgagtttctactgtagcgatgaatgtcgctgtcattggaacgttccccaagtgccttctagtgaaagccttacttcactcggaataacctgtggtcttttcttgaacgtgatggctctcttggttgtattcttcatgcacatgtgttacttttcctgtttaactacatgttaaagaaatgtgtatgttcctgtttaactgcatgttttaaaaaagtatgtgtatttttaagttataggcacgtgcaagaaagttcagagcaaaatagcttatattagtgaaacaataaatgtctactaata

SEQ ID NO: 41188 - DNA, 1102 bp, Homo sapiens
gcatgacttcattggcgtcagcaacgttttgctgttcgggtttagccgccatgtttaagttggccgggtttcgcaccactgaggtcatggatactcaggcctctttgcgtgtttcttcaacactgcttctaaggttaaccgcgttacatttgttggagaaaatcctgggaacgctgaaaaggactagtgggtggggtgcgagggtggggtcttgcccgaattaaagatggccgcagtcagctctgccccgcgcaatttcacgtcaacttttggagctgcgggagccggccagttggcctcagcgcctccttacggaattggcgtaaggcaaagaggcgcggctggaagaaccagactgagaaagtgccacagggcgggggccgcatccgcccctcggcttctggttactgacccgacggctttgtgagtgaaagtgaagagacacttcgaggcaggtgtctgtgctccccattcatccctgtttccgtggctatcttgactttcggggtgaaaagtgaggttaggccctgtttccccgacccttccctcgcgccatcacactctagtggcctggcacagccccagaggtcggccgctgtagcccccattgcggactcgccacattcatattggctcaccttgtcggtgcccggttcggtcctcttggagctcacactccagttgaggaaatgaatggacacaggaactactgggtaacaaaatactaataaagggctgcgattgtgtgagtttctactgtagcgatgaatgtcgctgtcattggaacgttccccaagtgccttctagtgaaagccttacttcactcggaataacctgtggtcttttcttgaacgtgatggctctcttggttgtattcttcatgcacatgtgttacttttcctgtttaactacatgttaaagaaatgtgtatgttcctgtttaactgcatgttttaaaaaagtatgtgtatttttaagttataggcacgtgcaagaaagttcagagcaaaatagcttatattagtgaaacaataaatgtctactaataggagaatggatgaataagtgtcattgttgaacaaattgacatacaacacgaacca

SEQ ID NO: 41189 - DNA, 385 bp, Homo sapiens
tgaagcaagcatgtcactcttttttgagattatctgaagaattttgctgcagtagccagagggaaaccgggtaaaattttccctatagggaacatgggttaaaagtctcacaagcctcatctgctggtgtttcttggaatgcagagtttggcgtggctttctcagcttcctaagtgcatgttcatccttctagaaagctctttctcctcttggttccctgaaatggtgctctagacccactttccctcagggactgagcctctaacttaattttcctcagtccctttccctacagggagagacacaggtcacattaagaattcatactggccaggctcggtggctcacacctgtaatcccagcactttgggaggccagggcgggc

SEQ ID NO: 41190 - DNA, 407 bp, Homo sapiens
gatccctcccagcccactcagcacaatggacatgctctctaccatccagtgactgcaccggcctcttcccctcagcacccacgtctggccatctcccaggaaacccggaccaccacgggcagggaccaccttcctcactgtccacatggaccaccccacacctgacctcagatgcagtcacaatacgtcctgcttcaatattgaaagggggaaaagctggaggaggggaaagatgaaagagaaaaaagcaagaggggagggtcacattcttctgaggctttgattacatctcactgagccccccacgttgcatgaaaaggaggggtggagggagcaattacgcattcgccttgtgctcactaaatctacactttataagcaaataaacagagtagaggaagaagtca

SEQ ID NO: 41191 - DNA, 400 bp, Homo sapiens
tcaacgactaaaccaaaaccaaatcaaaccatgtccagttaactcctatctagaaaaagaaaaaaaaaaatctccccttgaccctgcctgccttttccttttctctcctttccttcactaccagttttctgtatgagaactctgtatcattctctacatttcttcgcctatattccttccctaatctgctttagtatgaataagtctactaaaattactctcacaaaagggcacctaggacttgaggtgccagagcctatgttcttttactactagacattactaggacatttaacactcttcctttctgaagctctcgctttacctgttttttctagtgccacttccccttggttttctcagacttctcttaccactcctgctcagtatccccaccaga

SEQ ID NO: 41192 - DNA, 421 bp, Homo sapiens
aaattggcggccctcaaacaatttagatagggattagtctacagcccgtataatcttctggcatgccacaatgcatgttgttttttgcatatcatctttatttttctctttttgatagttattatatgagataaaaagagaaccatttctcagtgatgttacagacgagtgaagggagtatacagataagtaaacccacaattgtaacacaacatgaaatatgtcagggcacatagatgttgcacatttaggatgtaagcatactattagaagggccagaggagacttgcagatggaaatgattcttaggcagatatctgtagggtgagtagtaatatttaaaataatatatattaccctttgtatgtttctgtaactagcctatgtgttttgcaagcattaactcatttaattttatcac

SEQ ID NO: 41193 - DNA, 154 bp, Homo sapiens
aatcttttttcagaagtcacagtaatgatttatttgggcaaaaatcaccaattggtattaaaaccttaaagtgaaaatttgacaaagaatgataagagatatacataattgcagagaatctcctctcatacttattaatcacaaaaggaaagtt

SEQ ID NO: 41194 - DNA, 365 bp, Homo sapiens
tcagggtcaagatgctgggagctgccagtggcgctagaggaacccatgttttccattgtggattaaaatacccatttgcctgcggctgagcttcccctccgaatccaataggtcaataaggaccaaggacaaagcacaaacagggcctggaagccaagagatgtcgataaaaatggagatgaataggcatttcagtgcgggcaggccgtgggtgtggggcattgtcttttctctggccagcagtgcctggccactttgtctccaaacagtgcttccattttagagatgccagattggtttggacccaaagcttgactgttgcggggtgggctgaggtgggagtggggaggattcacaccagaaaa

SEQ ID NO: 41195 - DNA, 406 bp, Homo sapiens
tttggttgcatctggtttatccatgtcttctgctgtgatttgtgcctcttcttacctgagaaacctttgcctaccccataatcacgaatgttctccctggatgagctcgttgcctcttttgtgttcagctcactgaggtccggtctgaggctggggctttgtgtttggagcctgaggcaagggttgagggccatggtttgtaaggacaccagtggttccagcgccatctctcatttccaccactgacgcccctgatgtcttcagcaaacatcaaaccccagccaggcggctctgcttctggtctctgttctgttccgtttgtctgtctgcccataagctgataccaatcaaccttgatcaccatagctttgtagtaaatcttgaaatacagtcatgaaacttcaac

SEQ ID NO: 41196 - DNA, 291 bp, Homo sapiens
ctgcactctgaactcactgcaacctctgcctcctgagcttaagcgattctcatgccttagcctcccaatagctgggactacaggcatgtaccaccatggccagctaatgtttgtatttttagtagagatgaggtttcaccatgttggccaggctggtctcgaacacctgaccttaaatgatccacctgcctgggcctcccaaagtggtgggattacaggcgtgagccaccgcgcccagcctctatctctttttaatggagagaaggctgagaatggcagcaaggaatgaaa

SEQ ID NO: 41197 - DNA, 528 bp, Homo sapiens
tcgagaaaccccgggggcccgggggtgaccgatgtagaggaaggtctcaggccaagtggggcgttagggtataatacagtggcgacgtaaggagtgcccgcgtaaatgccctcctgcccgccctgtgccgctgctcccacctcagttccctgagcctctccgacaaccccatctccagtgcctgcctcctgagcctgctggagcacaccatggggctgatggagctgaagcaggtactctatcccatcccagttgactgctgcatctacctgcatggcgtctgccggggtcctatgaacgaggacaagctgtgccagttgcaggccgagatacagaagcagctgcaagccatgcagcaggctgacatgcagtggagcccctccactgtctttgcttatgcagctggtgcagtttgaatgaagaacaggagccaggctcagggaacagaagtcagagagggcagctggaatcacagctgaggccacatgttgtttgcaaggaacataaaataaacttccatgggaacta

SEQ ID NO: 41198 - DNA, 339 bp, Homo sapiens
cgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaa

SEQ ID NO: 41199 - DNA, 401 bp, Homo sapiens
acatattcacaaagtggcagacttttttaatccaaaaatttaactgcatgaatgtctcatttatagaacattattttacaatgaggttttacacatcaatcagttgagtcacttctttttttttttgagatggagtctcgctctgttgcccaggctggagtgcagtggtgtgacctcagctcactgcaacctccacctcctgggttcaagcgattctcctgcctcagcatcccgagtacaggcactacaggcacgtgagcaagagaagctgacagattcaaatgttcacaaacatttatgttctattttgatagatacataaactatatttctcattcttatatactttatattagggcatgggattaaagtcaaaatagtggaaaattagtagaaataac

SEQ ID NO: 41200 - DNA, 424 bp, Homo sapiens
accctttctatttcaagatttgttcctgaaaaacttttcccctaagtataggaatttgaaaataatgcaaccctttcctttaatttcacttgccctcagagacataactgagaacttcagctctctttgtacaatactgtagacagtataagaaatggactgagtctatcagacccatagttatccccaggaaactgatttctaaagaaatccctttagtagtttacttgctctttatcctaaaagatgagtgcaacaaaaacatggtgctagttggtttccaagtaataccagttttgaagaactactttaaagaaatacattgcagcaaaagcaggcatgtgaagcagtacgtgcactgacaggagtaccctgctggagaagcagctctaaccaacacagcgtcctgattcctaactgcttc

SEQ ID NO: 41201 - DNA, 836 bp, Homo sapiens
catgaagggatcaccatgactttgagagaaaaaagaatcagattaggcctaacattggttgaagaagattaaaatagattcttatattcaagcagaagggaaaaatgaagccaatctagaaaagtaagctaaaaatcctctccttggcttaggatcattgggtcaaactgggagtatatctgtgtgattacaacctgctgctatgagaaaaaagaattgtaacttgaccatgttggctcacacagggcaatgcaaaagaagtcaaaacattcatatcaggtcttggtatctgtgtcaggagaaacgtggtggctttcacagcttcttcacctctgtcctctgtcatgcaactccatttttggctaggtactatttcacatgcacactgtcctgggtgccagaaatacttgtggtgtacttggtttgagcagtacctctagtatgcaccattccagggaacatggttgtcaacataacaagtttagtgtgtgtatttgcagacaacatagccctgaaagcatgaaatgtagaataggtaaggtctgtcttagaaaaggaggaggaagtaccaatttggtgcaagaagatcgtggtgaggaaggacatgggagccacagtgaagtgaaagaggctttaaggaatcagatgcacagatggatgctttgatttacacatttatctagaggagtgattctcaaccttgactgtacataagaatcacctcaggaaatttttaaattcccaattatattaaaatcatttggagtgggaaccagacaccaatatttgcgaaagcctccaaggcggttctaatgtccagccaaagttgattatca

SEQ ID NO: 41202 - DNA, 803 bp, Homo sapiens
aactgcacaaccttgtggacctacttaaaacactgaattgtacaatttaaattggtgaattatgtggcatgtaaattaaatctcagtacagctgctaaacttgagaccatgggggaaaacactggaatttgctggctcagtgacttagcaacccagttacagcctgacatttgcccttagcaccaactcttggttctccatagcacagcacggataagcttctccctgcgagatccccagttgcacggtgaaaatgagcagatcacagatgagaagcctgagagctacagaataggaagggccctcatttaatacagcccttgactgccaactactgtgctgacttaattcactgaaaagaaaggaggacgttctgattctggccagaacggagtaagcccactgctgcctctctcctgccgactgccagcaaaacctatggacaaaacacaaaaacaaacacctgaggactctggggagtcaacccaagctgatggattgcagaggagagtcaaacccatggaagtggctgtacaggggaagagtttcccatgtttttccctttttcctcttgcagccttgccctgagtatgggctccaacatgcagaactgtgtggtggtgcaagaagctagaactccaatagaaactccatctttctgactagaggaacaaaagggggcccctgccgtcctcaaagaataggggtgagggttattgtaggttttttactctttcttgtggctgtgccccaaggacagtccccagtcacatgctgcatggtggcggcgatgccggcaggta

SEQ ID NO: 41203 - DNA, 403 bp, Homo sapiens
ccactgcaggggactggacctgaacccattgccatccttgggctctgggtgggaccccttttgaaagcttccactgaaccagaaagatagcacagtggtaaactgcttacaagggaggcactgcaacaaacatgaacattgctctaaaaattagtgtgcactctgggaggccaaggggagcagatcacctcaggtcgggagtttgagaccagcctgaccaacatggagaaaccccatctctaccaaaaatacaaaattagctgggcgtggtggtgggcacctataatcccagctactcgggaggctgaggcaggagaatcgcttgaacccaggaggcagaggttgctgtgagcggagatcaggccattgcactccagtctgggcagcaagagtgaaactccgc

SEQ ID NO: 41204 - DNA, 672 bp, Homo sapiens
aaaaatgttaacatatttcttaaaagttaagttagctgattcagcttcaaaaaaagttacttaattgaaataagttctttcaataggggaggtgctctgacatagcgatagtatggtttgataatacagtttttctcctctagctgcctcctgttcttgaggtaatgctcagtgattaactagataggactagataatttatttcaccttggcaggtcttgcctccaagttggcctattcctatggtatttccttttctttcttttgcttcttcctgcacactaagtatggtattttctgacagtatttttcttaattctttatttatttttcttggtaatttcttgctgtagagctggtacccattagacataatgactttccttgacttgcttcttgctcataaatttctgtaagacaatcaggaagtttttagaaacaaacagtggaaccaattaggctgttaagtgagacacgcctaaattaagctatgaggaaataaatacagctccagcaaaaatagaaataattttcagattatccatgcttttgtttccctggttttctttgaacctcatttcctcaagctatgaagtgaaatgaagtggtaagtacacctctaagtaggacattcagggtgaatccaaaggaacttgtgaatttgaccaaaaa

SEQ ID NO: 41205 - DNA, 298 bp, Homo sapiens
ctgcagagtaaagggactcactgaagaagaggaacgtgggggtcctcaagagagtgtctcatgccctacaaggtgtggggctgacctttatgggcttcttcaactaaagaggggtatattcatgaagattccaggaaaaggtaaagatttctcaagaccgtggtgccacaatttacacccaaatacaggtgttcctggagccgtcttggcactggtgggtgtacggtttcatatgttactgattgtacagtgagatcctaggtgaaacctacatcaaatacagcgccatgttgcttct

SEQ ID NO: 41206 - DNA, 445 bp, Homo sapiens
ctccagccctctgccttgtttgatatagactgggcaggggccacggtgaccccccgtcccgggtgtggcggccccctctcccacactccccggcaaggagtcaggagagggcagatgagcatcactgagaccaagccttggctctggcggcccttcctcccttcgcagggcctgggaagcatgtgctcagagctgcatttcaggaaagcagctgcagctcgtgacacgctttccacagcgggagatttatggggctgtgcggctttcatggtttctgtggggttcctattctccccctcatttgtcctggccgctgtctccgaggcagatgggtgacaagcctcccctagctggaccggcccaacaggaaggtatggctgtgtaggggaggggagaggctgaccacctcagcctccttcggagggggaagctgctgggagccact

SEQ ID NO: 41207 - DNA, 336 bp, Homo sapiens
gtccctgctcttcaggtccttgtgtgatgtgacccagctgacaccctagccccagatgactgcccctgaattagtctcagcttctccaacctgttcccttatcctctattcttgcatgtgctgataccgtattgagaacgttctttaatgttatttatctcctctggaataattctgactccctcctcaagcatcacctcctccaggaagccctctcggatcctccaggctcagccagtgtctccagtggtcctcacagtctcctgtacttcccaagctcatcatattgtcttcaaattccgtggttacatgttccccactcgcctgagaaacagg

SEQ ID NO: 41208 - DNA, 146 bp, Homo sapiens
gacattacagtacaacactctagactttataaacattgtacacttaagcaacactacatgtatttaaagtttttcttccataataaattaacccttgcttgctgtaacttttctactttataaatgttcaaatttttaaaagcttt

SEQ ID NO: 41209 - DNA, 2045 bp, Homo sapiens
  misc_feature (358)..(358): n is a, c, g, or t
  misc_feature (633)..(633): n is a, c, g, or t
  misc_feature (1058)..(1058): n is a, c, g, or t
  misc_feature (1355)..(1355): n is a, c, g, or t
tttaccttatctcttttaactatttatgaacaatgtacatttttgtgcatagaatggaatggttctaacagctttgatcagtttctaagttcttcatcatgtctgcgtagtgaattctgtagaatgttttttttgttgttgttccttctgcttcagttccctgttgttatagctggaggttagtaaacagagagaagcctcagccaagtggcataaaatatacttttatccacaaaaagaatatatatatctttccctttccaaatccattttattccagaaatttatgcatacaacaggaaataggatttggatagcaagcgatatagcaacacatttatcgaatttattcattcangcgtttggaaaacaggagtctggatagcaaaggttcagatagtgagagggattcctgcacattcacagactgggtttcttttgttaacatatttttattcaaaaatgcatttaccagtctttgctttttgatgaattgaccttgagctgacaatgtgactttcattcatggcatttctgagccctcattcctggccaggacacagaggtaccacatcccactgcaccctgccccaactcacaggagagatggtctgggatgctcttggaattttnctgtgactttcccaaaatctacagtaagttggacaagtccctgtccctctctggcctcagtttcaccatcagtgaaatgaggggatgaaccagattaagggctctctaactacatggctgcacttcagaacccccttccctggggaaacatcccccacccgggtccctggatgaggagggacctcatccaggttctgctgaggaggcctagggacagcatttccacatatttcctgaatgattcctcagcagccatcccagcccaagccactttcctgagcatggaagcctccagaattggtggccagatctaccaaccttgtggctgtgcaattcacctcattcaatcctcatggcagcccaggagacagaccatcttattcccactttgcacatgaagggctgagtttctgagaggtcataantcattcaagttagatcctagtctattggacacctacttactgtctgccagtcactgtgctaggtctaagctacagagatgagcagaggacagccaccagacccttgggagaaagattggcgtaaaatcaaataagagtaataattgacatattgccaagccatcccatctgcctggtgtgtcagataagagtcccagagcaggaaatggttggccgtggtctagcaaggtgagcagggaggagttcactgggcaaatgtgaggagggggcattgtaagaggaaggaggagcacaggngcccagggccagaggcaggagactgacactgtgcctggaattgggaaccagcagctggtgaaagtgcaaaggtagacagaaattagaacacagaaggccttaatgtgtagaactgccctgaagccagtgggaagctactgttgggttttaagcaggaggcatggactgaccaggtttgcatgtgagaattgattctagaagctgggtggagacggaggttgatgctgagacctgaggctggagaccactcccccgttccatccacttctcagcctccgttttctctgtggaaaagtccagatcccgacttatactgtctctgtcttacggattagtgtgagagtcaaatgagatcattattgccaataggctctgtcaatacatagaatttagttgaccattttcattgtcttcacttgtgggttaaataaacactaaaataaaaacatcagggagcctggctgagcagggaataacctcttggaggaaggaaaacattcccctttatatgtcagcaactttgaccctagagggaatcagaacccatgcctttggggggtgttcctgcagacacagagctgttctccccctgggaacctcaccactgctcaaaatgtaatgcaaacatgaactgacttagttatctcaatgttcaaacttgaaaaaaaataaacattatgttccaaaaac

SEQ ID NO: 41210 - DNA, 448 bp, Homo sapiens
aaatccagtgcagggctaccatcctgatagagcggcttggtaccagtgtcccacaccccaatgtaggcattgcccatggggacgagaggggacatagacactccttgggggccttttgtgtaggaaccgtgaccaccagtccagtgtctcagtctgtggtctctcctttaaagtaggaatcttcctaattagctgatcactctcgttcttcctggactccccagtgtctttcagaaatagcttctggtaagttgcagcttgctcatgatgggagggaaggaagaggaagtagaacagtagaggcagaacaattaaaaataaatggtgaagggcctggtgtgtggctcacacctgtaatcccagtactttgggaggctgaggaaggaggattgcttgagctcaggagtttgagaccagcctaggaaacatggtgaaacctgtctctacc

SEQ ID NO: 41211 - DNA, 440 bp, Homo sapiens
taatgaagaggtttagaagtatttgcattggaacagatatggaaatttctggaaatgtttgggcaaggacatttagatttcataagtgtatatgtgtatgtaaaatatattcttcaccatgactgacttttaaaatttacattttacttattggccaggcacggtggctcatacctgtaatcccagcatttggggaggccaaggcgagaggatagcttgaactcaggcgttcaagaccagcctgggtaacatactgagatcccatctctactaaaaattaaaaaattacctgggcatagtggtgcatgcctgtagtcccagctacttgggaagctgagatgggaggatcacttcagaccaggagttggaggctggctgcagtgagctgtatttgtgccattgcactccagcctgggtgacagagcaagaccttgtctggg

SEQ ID NO: 41212 - DNA, 481 bp, Homo sapiens
ccttgaattcttgggactatggtacttaaacctaattacctagaatgaattaagatcactttaatatggctgagactaaaaagtaacaaaaactgttggccacagacttccaaatatgctcattgtatatctggaagcatttcaaacaccagacctttgtatacaatagcacacaagttgtaattcagaaaattcagtcagtggactaacttgaagttaggcagaatgaagctggaaagtgggtttgtgctaaattttaaaagaagtggttcaacatggacagacagaggggaacaacacactctggggcctttcagagggtggagggtgggaggaaggagaggatcgggtagaataactaatgggttccttgcttagtacctgggtgatgaaataatctgtacaacaacccccatgacgcaagtttacctatgtagcaaacctgcatttgtacccgtgaacttaaatgttaaaaaaaaga

SEQ ID NO: 41213 - DNA, 165 bp, Homo sapiens
ctggtctgataagtgctggatccaaagtttctattcggtttgtggccatgataactttcacatctcccctagaatcaaatccatccaactggttcagcagttccaacattgttcgctgaatttctctctcaccaccagaattggagtcttatctttttgtcccaa

SEQ ID NO: 41214 - DNA, 738 bp, Homo sapiens
tagaggatcccctgagccgagattgcgcgctacactccatcctgggggatagagcgagactgtgtctccgaacaaaaaaaaaagatgttactttatatgctagacttttccaatagtatacctttaggatcatactaaattgttggtagcttatttgttaaaggtggaatgttaggttaaaatgtattaatctgaggccaggcacagtggcttacacctgcctcagtctcccaaagtgctgggattacaggcatgagccactgtgcctggcctcttctatgcttaagagcttttccaatctcaaaacagttgaccttagggagtgcatatccgagaatgcagtgatcactggcttattcctgacgaacaggtagtattttgcccaattttttatattaattacctcctaacttcagaagggtggtagtatccccattacaaaaatggagaggctgggcgtggtggctcacgcctgtaatcccagcactttgggaggctgaggtgggtggaccatctgagatcaggagttcgagaccagcctggccaacatggtgaaaccccatctctactaaaaatataaaaattagccgggcgtggtggcaggcacctgtaatcccagctactcgagaggctgaggcgtgagaatcacttgaacccaggaggcagaggttgcagtgagccgagattgcgctgctacactccatcctgggggatagagcgagactgtgtctccgaaca

SEQ ID NO: 41215 - DNA, 328 bp, Homo sapiens
gaaaaactattgaaatacaaataaagtctacagttaagggaaaaaaaaatcagattctatgatcttcctaggcaaacctgatgataaatttacttatttccataagcttttttgacccccaggggaattaacagatatagtcagtaatttttattaaatatttaacattcacatttaatacactagcctatgtatgttataaagcaaaatgtatttccacgttaacattccagcccagttgagtcctcctttctaagtacttttggaagaataacaagttatctttcaattatttacaacggagggaagggttcatattatatatttc

SEQ ID NO: 41216 - DNA, 274 bp, Homo sapiens
tatatttaacctgaaaataatctttggtgtatacgttgatgagcctaggcctttgcagacctcttacagttactctgtcacagcccttcaaaggttctttgacttcagattaagaatcaattgcatgtggaatgcatgtgcaaaggaagagatattcaaggcaattgttaccatgtaccataaaccttgtacataattttttgtcattttcttttcctctgtctctatcccttcttctttgacacacaatagacacctagtcaatttattacaa

SEQ ID NO: 41217 - DNA, 154 bp, Homo sapiens
acacacaggaacccataacaatcctcaatccggagcaataggacttctgcaacacttttcccccaaattcaaatctcctttgaagagcctaaagcttaaaggcataagcttaaccctgggctatgtgggaagaggcagtctgagaaaaacttca

SEQ ID NO: 41218 - DNA, 547 bp, Homo sapiens
taactccctggggactgaggtgggcagacagacctcagtgaccctttccaataatcttttaagaatattgctttactgagatatgattcacatacaaaccaagggtattgctacagcatttacgtgaacaaaaagcgatatgtttgtgatttcaaaaagatatataaagatgccctcccctttgtggcttatgtaagacctgaaacacaaactttagcaacaaaatgttgcgtagatataggagttatatacagtgtcagtgaagagagacctggacctcaacagaaggtaggttgggatttacaagggacaaaacacggttaccactaatagttttttcaaatactcgactttctatcacccaactttcaacatttcatgtttttttgatgcatgaaatactatcttctctttccagggaaggcttcctatctgtgtggtgatgaatcgcatttcctgagaacaaaataaaaggatttttctgtaactgtcacctgaaataatacattgcagcaagcaataaacacaacattttgtaaagttattt

SEQ ID NO: 41219 - DNA, 2010 bp, Homo sapiens
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagttattt

SEQ ID NO: 41220 - DNA, 1900 bp, Homo sapiens
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatgttacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgatatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagttattt

SEQ ID NO: 41221 - DNA, 2231 bp, Homo sapiens
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaaggcttatctgatctccttgccttttctccctcatgcttctttgtctatttctggttcatcctacatgaacaagaaatgcacatgtagctaacagaccccgatattgttcctgtgtttttctgggtatcagccactccttatggggtggcaatgctgcatttgtgcttgcccttctcttgctgttcaatcagttttctagataaccaagaggcgcttaagtcctctgccttcctactcatgtattcagctgtctggaccacaaaggagggatgatggaacctctgaatgttgacagaaag

SEQ ID NO: 41222 - DNA, 1097 bp, Homo sapiens
aagagaacttttgtaaaatgatctatagccaaaatgtcctcttaaattactctgtgaccaagacagaggagaaaattagcttttgaaagcagagtcagtattagatctgactggattacaaaatagtggaattgggttttttgctctttctctaatttctaatatacaaaattttacacattgcaggtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagttattt

SEQ ID NO: 41223 - DNA, 2062 bp, Homo sapiens
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagttattt

SEQ ID NO: 41224 - DNA, 1780 bp, Homo sapiens
gaaggagaggagtaggagaaagagaaggagctctgttggtaatggtgggaaaattagtcattgtgttttctcagtgagtacagaagctttactttaccatgactaaaaattgtccttttcttctctgttgtatagaataatgttttacaggaaaaaatatgtgctatggaggggctgccacgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtgaaaatgtgtgtcaagaacgagatgctgacccagacaccttctttgcgaagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccattacctcatcaggctcacgaagatagctccccaactctccactgaagaactggtgtctcttggcgagaaaatggtgacagctttcactacttgctgtacgctaagtgaagagtttgcctgtgttgataatttggcagatttagtttttggagagttatgtggagtaaatgaaaatcgaactatcaaccctgctgtggaccactgctgtaaaacaaactttgccttcagaaggccctgctttgagagtttgaaagctgataaaacatatgtgcctccacctttctctcaagatttatttacctttcacgcagacatgtgtcaatctcagaatgaggagcttcagaggaagacagacaggtttcttgtcaacttagtgaagctgaagcatgaactcacagatgaagagctgcagtctttgtttacaaatttcgcaaatgtagtggataagtgctgcaaagcagagagtcctgaagtctgctttaatgaagagagtccaaaaattggcaactgaagccagctgctggagatatgtaaagaaaaaagcaccaaagggaaggcttcctatctgtgtggtgatgaatcgcatttcctgagaacaaaataaaaggatttttctgtaactgtcacctgaaataatacattgcagcaagcaataaacacaacattttgtaaagttattt

SEQ ID NO: 41225 - DNA, 1553 bp, Homo sapiens
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggccaaatcatgttgtgaagaacaaaacaaagtcaactgccttcaaacaagggcaatacctgtcacacaatatttaaaagcattttcttcttatcaaaaacatgtctgtggggcacttttgaaatttggaaccaaagttgtacactttatatatattgcgatactcagtcaaaaattccccaagattgaatttaaggagcttatttctcttgtagaagatgtttcttccaactatgatggatgctgtgaaggggatgttgtgcagtgcatccgtgacacgagcaaggttatgaaccatatttgttcaaaacaagattctatctccagcaaaatcaaagagtgctgtgaaaagaaaataccagagcgcggccagtgcataattaactcaaacaaagatgatagaccaaaggatttatctctaagagaaggaaaatttactgacagtttacttttgaatactcaaggagacatccagacctgtctataccagagcttttaagaattgttcaaatatacaaagatctcctgagaaattgctgcaacacagaaaaccctccaggttgttaccgttacgcggaagacaaattcaatgagacaactgagaaaagcctcaagatggtacaacaagaatgtaaacatttccagaatttggggaaggatggtttgaaataccagtatgttgtttgcacaagtgggctaacacttgccactagaattgaatacataatccctcgaagcgtaaaaaagttagctgtcaagtttttcagttatggccgattcataaactcttggaagaatttttttttaaagtcaagaatgcctattgaactgtcacattaatcttttatcagaaatgaagctaaaaataaaagaaatacaggattctggagacattga

SEQ ID NO: 41226 - DNA, 689 bp, Homo sapiens
gttacttttttactgataatgtgaaagaatgatataaaaacttgattttcctcaacaacattactttcttttgtaaatgtggtttctacaaagatgaaactactaaaacttacaggttttatttttttcttgttttttttgactgaatccctaaccctgcccacacaacctcgggatatagagaacttcaatagtactcaaaaatttatagaagataatattgaatacatcaccatcattgcatttgctcagtatgttcaggaagcaacctttgaagaaatggaaaagctggtgaaagacatggtagaatacaaagacagatgtatggctgacaagacgctcccagagtgttcaaaattacctaataatgttttacaggaaaaaatatgtgctatggaggggctgccacaaaagcataatttctcacactgctgcagtaaggttgatgctcaaagaagactctgtttcttctataacaagaaatctgatgtgggatttctgcctcctttccctaccctggatcccgaagagaaatgccaggcttatgaaagtaacagagaatcccttttaaatcactttttatatgaagttgccagaaggaacccatttgtcttcgcccctacacttctaactgttgctgttcattttgaggaggtggcgtcgacgcggccgcgaatttagtagtagta

SEQ ID NO: 41227 - DNA, 1377 bp, Homo sapiens
  misc_feature (24)..(24): n is a, c, g, or t
tcgaggcaagaattcggcagaggnttacaggaaacttgataatgaagatctccaccctggtcaagaacagaggaaagacctaaagtgaggtcagctaaaaacaagaaagaaatttaaagcatcctgggaagtcatcataccctttttctccaagaaaatctagttttgcttgtttttgtgtatcccacaacacctgtgtttgactatctttttcactttggatttggattttggtgtgatatacacagttccaaaaaatcaatggatagaaaactcaatggcataaataagtgcttaaaacaatacttcaagaaatgttcaacattccacgagaacaatatccacgtgagatgaaaagaaaagtctaagttagttcctgattcctggaagctgggaaagtctcattccagtaactacttaataccccctgtcagtctccttcaaaggctgaagccagcctctgactgaagcgcagccgcaatgtttcctgtctggtgccagcacagcttgcctggacttctgaaaattgcaagcgcttgctccttgctagtcaccacactccccctttcttagttgcagactccctcttgctgtggtttaccaggtgcccttattgcccctcatgcttgtgtgccactttggacttaatctggcacacttaactcccttcatctacgcctgaagctggacaagctgaagtgactgcgtcactttctcaattctggctcctgcccaccgaccttgctctgctaggaggaattagctctgcctggccagaacccaagaagtgacaaatcaaactcgctcaataggtggtaattaaacttctggctctaaagcccagaataggttgtcaatgggatttcacagtggctccctgacactaagcaaggatgtatttctacatctagttttaaatcttaaactctaataggattctcagaaaagacagtaaagactaaggccaaaaaaagttgtttaaaggggaaaatgacagtaagtacaaaagataatctggggaagacctggcaattctgaaatcaaaacatctgttactaagtggatcatgactgcttagtttctagtctagaatctttaagtaagccattcagaagatgtgatactatagaatgataccaactgaggatagagtggagaggaagggctgaagatgacttcagaaaaaggcctgaggcgtgacaaatgttgatctcactcactgatctatgctgtatttcttttaagaatgtattaatataaatgtccttttcttcccacatccaatccctattactacaccaaatacttgttcctctaggaaatgtgaagttgaaaaaaatttcccccattaaatgagaattattctgcttatgaaat

SEQ ID NO: 41228 - DNA, 340 bp, Homo sapiens
gtggagcaagcttctcaacgatctgttcccttttagttacaggaaacttgataatgaagatctccaccctggtcaagaacagaggaaagacctaagtaagtcttattatatttttaattatttaaaatatgctttcatttatgattgaagactattttacaagtttgtctgtttctcataaactatttaataccagaattataattgcctgccaatttgtctccatgtctgcttctcccacaaaacctagagctccttgaggataagaactatgtatatatcatatatctttgtatcaccagtgttttacatagtacctggccacacgttgagaagctgg

SEQ ID NO: 41229 - DNA, 1149 bp, Homo sapiens
  misc_feature (24)..(24): n is a, c, g, or t
tcgaggcaagaattcggcagaggntccttaactttacctgacagaactacaaagatttaggagtgcttaaaacaatacttcaagaaatgttcaacattccacgagaacaatatccacgtgagatgaaaagaaaagtctaagttagttcctgattcctggaagctgggaaagtctcattccagtaactacttaataccccctgtcagtctccttcaaaggctgaagccagcctctgactgaagcgcagccgcaatgtttcctgtctggtgccagcacagcttgcctggacttctgaaaattgcaagcgcttgctccttgctagtcaccacactccccctttcttagttgcagactccctcttgctgtggtttaccaggtgcccttattgcccctcatgcttgtgtgccactttggacttaatctggcacacttaactcccttcatctacgcctgaagctggacaagctgaagtgactgcgtcactttctcaattctggctcctgcccaccgaccttgctctgctaggaggaattagctctgcctggccagaacccaagaagtgacaaatcaaactcgctcaataggtggtaattaaacttctggctctaaagcccagaataggttgtcaatgggatttcacagtggctccctgacactaagcaaggatgtatttctacatctagttttaaatcttaaactctaataggattctcagaaaagacagtaaagactaaggccaaaaaaagttgtttaaaggggaaaatgacagtaagtacaaaagataatctggggaagacctggcaattctgaaatcaaaacatctgttactaagtggatcatgactgcttagtttctagtctagaatctttaagtaagccattcagaagatgtgatactatagaatgataccaactgaggatagagtggagaggaagggctgaagatgacttcagaaaaaggcctgaggcgtgacaaatgttgatctcactcactgatctatgctgtatttcttttaagaatgtattaatataaatgtccttttcttcccacatccaatccctattactacaccaaatacttgttcctctaggaaatgtgaagttgaaaaaaatttcccccattaaatgagaattattctgcttatgaaat

SEQ ID NO: 41230 - DNA, 451 bp, Homo sapiens
gcttgaacactccagacatactgctgcctcagggcctttgaaaatacatcacatgactaactttggcatctccttcagtcttcagtcacatatgcctttacagtgcgatggcactgtagaagtgtaggtgatatcacaacttcctcaattctttgacttgtcacaatgagcataaattacttttgtaattttataggacactcatggagggaaatctatacacagaaacacacacacacagggagaaagccatgtgaagacaggcagagactggggtaatgcagctacaagggaatgtcagagattgctagcaaacaccagaagctggaagaggcaattaaggattgctccctagagcttttagagggaggacggctctgccacctgccttgttcttggactcctagcctccagaattgtgagagaataaatttctgttgtttaaactatc

SEQ ID NO: 41231 - DNA, 313 bp, Homo sapiens
gtggagcaagcttctcaacgatctgttcccttttagttacaggaaacttgataatgaagatctccaccctggtcaagaacagaggaaagacctaagtaagtcttattatatttttaattatttaaaatatgctttcttgtataaggggggccgggtcatcgcgacggggcttttacatgaattggacgactgtaacaggaggatatccgtcgcgcgatgcgacgcagtgatcggttcgcctggcacaacattggagcttcgtcttgccgagagatatccggtgaggactagagatatattgcgtccagcagta

SEQ ID NO: 41232 - DNA, 1536 bp, Homo sapiens
gcttgaacactccagacatactgctgcctcagggcctttgaaaatacatcacatgactaactttggcatctccttcagtcttcagtcacatatgcctttacagtgcgatggcactgtagaagtgtaggtgatatcacaacttcctcaattctttgacttgtcacaatgagcataaattacttttgtaattttataggacactcatggagggaaatctatacacagaaacacacacacacagggagaaagccatgtgaagacaggcagagactggggtaatgcagctacaagggaatgtcagagattgctagcaaacaccagaagctggaagaggcaattaaggattgctccctagagcttttagagggaggacggctctgccacctgccttgttcttggactcctagcctccagaattaggtcacctgttgggcaatatcaccatagactgaatacagaagcagatattagcctccagcctcctgctcatctggacactagagagagtgaggtcagctaaaaacaagaaagaaatttaaagcatcctgggaagtcatcataccctttttctccaagaaaatctagttttgcttgtttttgtgtatcccacaacacctgtgtttgactatctttttcactttggatttggattttggtgtgatatacacagttccaaaaaatcaatggatagaaaactcaatggcataaataagtgcttaaaacaatacttcaagaaatgttcaacattccacgagaacaatatccacgtgagatgaaaagaaaagtctaagttagttcctgattcctggaagctgggaaagtctcattccagtaactacttaataccccctgtcagtctccttcaaaggctgaagccagcctctgactgaagcgcagccgcaatgtttcctgtctggtgccagcacagcttgcctggacttctgaaaattgcaagcgcttgctccttgctagtcaccacactccccctttcttagttgcagactccctcttgctgtggtttaccaggtgcccttattgcccctcatgcttgtgtgccactttggacttaatctggcacacttaactcccttcatctacgcctgaagctggacaagctgaagtgactgcgtcactttctcaattctggctcctgcccaccgaccttgctctgctaggaggaattagctctgcctggccagaacccaagaagtgacaaatcaaactcgctcaataggtggtaattaaacttctggctctaaagcccagaataggttgtcaatgggatttcacagtggctccctgacactaagcaaggatgtatttctacatctagttttaaatcttaaactctaataggattctcagaaaagacagtaaagactaaggccaaaaaaagttgtttaaaggggaaaatgacagtaagtacaaaagataatctggggaagacctggcaattctgaaatcaaaacatctgttactaagtggatcatgactgcttagtttctaggtgagctgaataaaaatactaactgaaca

SEQ ID NO: 41233 - DNA, 287 bp, Homo sapiens
tgcttaaaacaatacttcaagaaatgttcaacattccacgagaacaatatccacgtgagatgaaaagaaaagtctaagttagttcctgattcctggaagctgggaaagtatgtattttatttgtgtatttgcttaacaaacatttatagggctaattataggccagatacttttccacagatttctaaaatattattattaattctcataactaccctctgaggtatgtactactactgtcccccttttacagatggggtaacaggtatagagaagttaaggacttg

SEQ ID NO: 41234 - DNA, 302 bp, Homo sapiens
ccccctgtcagtctccttcaaaggctgaagccagcctctgactgaagcgcagccgcaatgtttcctgtctggtgccagcacagcttgcctggacttctgaaaattgcaagcgcttgctccttgctagtcaccacactccccctttcttagttgcagactccctcttgctgtggtttaccaggtgcccttattgcccctcatgcttgtgtgccactttggacttaatctggcacacttaactcccttcatctacgcctgaagctggacaagctgaagtgactgcgtcactttctcaattctgg

SEQ ID NO: 41235 - DNA, 261 bp, Homo sapiens
gctactcttactggtaggagccattcaaggaatctaagcatgaacctcggggttcaaatctgatttttctgaatttgagatatcagatcctctatcatcaagggagaaatggtaattacttcacagcttgtacatagaataggaatttagcctgttgctgggctaatctgttctcttctagttctatttcttcctctagctcatctcttatcattaatctccttgatggttgtctcatttttaccttcttattggcctaaa

SEQ ID NO: 41236 - DNA, 637 bp, Homo sapiens
aaagatacaaattgccagtattaggaatgaaataggacatcactaacagatgctacatacattcaaaggaggctaagggaataatgtggacaacttcaagccaataaatttgacaatttaaatggaagagacaaattccctggaagacacaaattaccaaaactgattcaaaaagaaatggaggctgggcgcagtggctgcctctgtctcccaaagtgctgggattacaggcatgagccactgtgtctggcctcactggtaaattctataaaacatgtaaggaagagataataccaatcttaaccatactctttcaaaaaacggagaagggaacacttcaactcatcctaggaggagactagcacaattctaataccaaaccagaggaaaaaaaaacttcaaaatggtgtctctcatgaccctggacagaaaagtccttaacaaaaatactggtaaatcagattcaacaatctgtaattcacaaagataacatcagtatatgttctcctgacagtgggtccttagtataatcattgtctacttcatttctttgcaatgctattattaaggcttgatggaatatttattttttaaacagcttaattaaggtataatgacatgcaatatactgctcata

SEQ ID NO: 41237 - DNA, 327 bp, Homo sapiens
aaagatacaaattgccagtattaggaatgaaataggacatcactaacagatgctacatacattcaaaggaggctaagggaataatgtggacaacttcaagccaataaatttgacaatttaaatggaagagacaaattccctggaagacacaaattaccaaaactgattcaaaaagaaatggaggctgggcgcagtggctcacgcctgtaatcccaacactttaggaggctgaggcaggcggatcacgaggtcaagagatcgagaccatcctggccaacttggtgacaccccatctctactaaaaatacaaaaattagctgggagtgg

SEQ ID NO: 41238 - DNA, 251 bp, Homo sapiens
cagccaggaaaacctgaatatttcacacctttcttaaaatctttcagtggttgtcattgccctgttctctagtctcacttcttgttgttcccgtttttgaattctatgcttcagccacactgatcatttttcactttctcaattatgtcattttctcatctcctagtcttaatacatttccttctcctacttccacaatccttattgtctctcttctttgactaccaattttacaggtctcaggttcaaca

SEQ ID NO: 41239 - DNA, 449 bp, Homo sapiens
aaggacccttccttcattcatcacacactggctccatctgcactgcacctactgccagccaggcactgagcttcacatccgcacaaaacacaaagacctctgatacggtttgggtctgtgttcccacctaaacctcgtggtgaattgtgattatgttgagttgttttggaggtagggcctggtgagaagtgactcgatgatggggtggatttctcatgaatggtttagcaccatctccttgatgctgttcttaagatagtgagttttcacgaaatctggttgtttaaaagtgtgcgccccaccccttgcttctgctctggccatgtgatctgcctgccttccccttcgccttccaccatgattgtaagattcctgaggcctccccagaggctgagcagatatcggtactacgcttgctatacagcctgcagaactatgagccaattaaa

SEQ ID NO: 41240 - DNA, 1674 bp, Homo sapiens
  misc_feature (1552)..(1552): n is a, c, g, or t
  misc_feature (1674)..(1674): n is a, c, g, or t
tcctgttctggcagactcatggcgaggtggagcggcgcattgtatcacagttgttgaccctcatggatggcctaaagcagagggcacatgtgattgttatggcagcaaccaacagacccaacagcattgacccagctctacggcgatttggtcgctttgacagggaggtagatattggaattcctgatgctacaggacgcttagagattcttcagatccataccaagaacatgaagctggcagatgatgtggacctggaacaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccggtgggccttgagccagagtaacccatcagcactgcgggaaaccgtggtagaggtgccacaggtaacctgggaagacatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccgggctgacatcattgatcctgccatcctcagacctggccgtcttgatcagctcatctacatcccacttcctgatgagaagtcccgtgttgccatcctcaaggctaacctgcgcaagtccccagttgccaaggaatgtggacttggagttcctggctaaaatggactaatgggttctctggagctgacctgacagagatttgccagcgtgcttgcaagctggccatccgtgaatcatcgagagtgagattaggcgagaacgagagaggcagacaaacccatcagccatggaggtagaagaggatgatccagtgcctgagatccgtcgagatcactttgaagaagccatgctttgcgctgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggngcttgcccaggagagggaccaggggtgcgcccacagcctgctccattctccagtctgaacagttcagctacagtctgactctggacagggggtttctgttgaaaaaatacaaaacaaaagcn

SEQ ID NO: 41241 - DNA, 1195 bp, Homo sapiens
  misc_feature (1073)..(1073): n is a, c, g, or t
  misc_feature (1195)..(1195): n is a, c, g, or t
aacgtcagtacgaggctggtgttgatcgggggcctagaggatgtcaaacgtgagctacaggagctggtccagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccgggctgacatcattgatcctgccatcctcagacctggccgtcttgatcagctcatctacatcccacttcctgatgagaagtcccgtgttgccatcctcaaggctaacctgcgcaagtccccagttgccaaggaatgtggacttggagttcctggctaaaatggactaatgggttctctggagctgacctgacagagatttgccagcgtgcttgcaagctggccatccgtgaatcatcgagagtgagattaggcgagaacgagagaggcagacaaacccatcagccatggaggtagaagaggatgatccagtgcctgagatccgtcgagatcactttgaagaagccatgctttgcgctgccgttctgtcagtgacaatgacattcggaagtatgagatgtttgcccagacccttcagcagagtcggggctttggcagcttcagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggngcttgcccaggagagggaccaggggtgcgcccacagcctgctccattctccagtctgaacagttcagctacagtctgactctggacagggggtttctgttgaaaaaatacaaaacaaaagcn

SEQ ID NO: 41242 - DNA, 630 bp, Homo sapiens
tgagtgtcattacagatacctggatcatgatgatcctgaaaaacaggtcacagggccaacagctgatgagtatttggagcatcttattcccccaagatgaccactccctgtcttctgctacacctatattcatcgggggggggaggtgggaaaatagcaggattcttggggactctgagggcatgaatggagaattatttgattgaaaccacagagctcttgtacttagtattaaatattaaaatagaaatgaaaagttcagcttttctgagctgtaccatagcggccaatggaggaagtcttacaaagaaaatctatatctgcacaagactgaagccactaaaccgagtatacacaacataaagatatcttcctatttcaagtatcccttagggggcatgggtgcttagctatcctatgaaagacagagaagataagctcaattttagagcccagagcttgctccggaacagcaagatccacatgaacttaaactctttcccactgagcctaggggtggaatgtaattcctctgatggttttgatttatttccaagctagacttctctatttgatcattggcaccttggcagctcacacatctccgtggtctcttctgtagctttcaga

SEQ ID NO: 41243 - DNA, 970 bp, Homo sapiens
gcttttgctgcttccttgagagaagttttaacacatgaaaatggctaagagcaaaggctttggcaccgctgcctgctttcagattgctgcttttgctagccatgtcatcttgatcctgtttcttcccttctctgggccttggtttccccatttgtaaaatggtaatggtggcaatagtactcatcagttattgccaccacaatgctgcccagcaaactacctcagtagcacacagtagtaagtgtttgttgttcacacatctgggctggccagagggctttgctggtcttggctggccttgctcatgtctggatggctttggctgaggggaatgactgagatgatttgtctcagcttcctgtatctctctcatcctcctctagtggtgtagcccaggcaaattctcatggatctggcaaaggtacaagagccagtgagccactcatgtaactgcttttaagttcttttctcacccgccccccaccatgtttgctgccatcccattggccacagcaagtcacatggccgagcccagcatcaaggctcctggcagactgcacttcccaggatggcactgcagagtcacagtgccaaggtgtatggaattggggtgttttttgcaatctaccatgagtactaacctcacagtttcgtatgcaagcaaatcctcatccacttaccagtcttaggacagaggatcctcactggtctcctcgaccttgagacacccagattaggaattcttttctcctctgacttcttgtagttccctccatatactgttctattacccccgtccatgacacctttgtactgctgttccttctgcctgtaatgcctaccccttggcttacccatctgatcaactcagctctggggtcagactgtttgggtttaaagctggttcatgtcatttatttaaagcttcatgaccctggcaagtttctcaccctctctgggcttcaggtgc

SEQ ID NO: 41244 - DNA, 910 bp, Homo sapiens
aaagaattactatatgttctggccccttcccctctagttaaacaggtgttcaaggagctggagtttctgggttggtataccacaggggggccacctgacccctcggacatccacgtccataagcaggtatgcatgctcacacctgtgcatgctggggcagagaatggagaatgaggggaaggagaaaggtagggggcactgacttcctgtgcattgtccctctcttccaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41245 - DNA, 1165 bp, Homo sapiens
  misc_feature (1152)..(1152): n is a, c, g, or t
  misc_feature (1155)..(1155): n is a, c, g, or t
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccaaaaaaaaanganacagaaaaac

SEQ ID NO: 41246 - DNA, 873 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcagggtgtgtgagatcatcgagagccccctctttctgaagttgaaccctatgaccaagcacacagatgccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41247 - DNA, 864 bp, Homo sapiens
gacccacgcgtccgcggacgcgtggggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccaaaaaaaaaaaaaaaaaaaaaaaaaaacacagacgagctaaacaaagcaaacaaaaagagagggggggcgcggataaaagataccccagaggggcgcgcccagtagtagagtaccccgaaaatcggcgagacacaagggggcccccaaagagggagccgcacaaaacaggcaaaagccagcggacgggagattacaaaccggcggacacggggaaacagcggaaccggggcaacctggggagagacacccaaaccggggaggggagcaa

SEQ ID NO: 41248 - DNA, 976 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtgtgagagtggaatagatgtggggaagaggagtgggagttaaaaaaaaaatgtacagggtggggaagatggagagggttggaaagaaacaggagaggagaccaagaacaggggagaaaaagtgaagagtagctggagagatctcagaaaaagaaaacgttcagagttctttctcaaaagaaagcaaaggatgagaggagacaggatagaagggagtagttattctaaactgagccaggatttgaggagggaggagagaagctggtgaaaatacaccaggagcttcacattgaggaaggatggtttaaagaattactatgtcaggccgggctcagtgactcatgcctctaatcccagcactttgggaggccgaggtgggtggatcatgaggtcaggagttcaagaccagcctggcaaacatagtgaaaccccacctctactaaaaatacaaaaattagtctggcatggtggtgcgtgcctgtagtcccagctacgcgggatgctgaggcaggagaattgcttgaacctgggaggcggaggttgtggtgagctgagatcatgccactgcactccagcctgggcaacagagcgagattccgtctcag

SEQ ID NO: 41249 - DNA, 754 bp, Homo sapiens
  misc_feature (426)..(426): n is a, c, g, or t
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgcaggatgatctggtggctctggagttggcgaagcacgtgagggcccggaagataatcgacggtgagtgcaacatccgtttgcacgtctgcgtcgtcccaccacctggtgcgtagagggagtagaagcagtttagtccattcgcagccaaggcggaagtcatctaatctaaccacgccagaggntacggcagcgacgctattcagagactacgcgttcgtttacagagggaagcttgggaagcttttgcgtagagggtctagggtgatgaccacacaagagggggggagcccacacgtggaacgcccactccggggagcgataccgacagttccacatagagaggcaacggatgctgatgacaggactcccataggtgagagaagacccaccctgtcctctctcgtgaaaaagatgtggcaacccccttgatgagaacccaaagtgcgacgcactgaggaatccctatccctgtggctcgaagcgcgattatatgtgaaagatcagtgatct

SEQ ID NO: 41250 - DNA, 1723 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactactaaaaaaaaaaaaaaaaaaaaaaacaaaaaaaaaaaaaaaaaaaaaaaaaaaaaaaaaaaacacagacgagctaaacaaagcaaacaaaaagagagggggggcgcggataaaagataccccagaggggcgcgcccagtagtagagtaccccgaaaatcggcgagacacaagggggcccccaaagagggagccgcacaaaacaggcaaaagccagcggacgggagattacaaaccggcggacacggggaaacagcggaaccggggcaacctggggagagacacccaaaccggggaggggagcaa

SEQ ID NO: 41251 - DNA, 1614 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactactttcctgagctaaattaacttgtttttcacatacgcaaaaaagaagggatagtaagcagatttttattagaaagaagtccaagccttgatcctgtgggcactgtgaattaccaggagggagagtttctcaatgaccgtttactacatattttggagaggcagctaggaagtggtctaaaggttgggattgctgt

SEQ ID NO: 41252 - DNA, 1411 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccaaaaaaaaaaaaaaaaaaaaaaaaaaacacagacgagctaaacaaagcaaacaaaaagagagggggggcgcggataaaagataccccagaggggcgcgcccagtagtagagtaccccgaaaatcggcgagacacaagggggcccccaaagagggagccgcacaaaacaggcaaaagccagcggacgggagattacaaaccggcggacacggggaaacagcggaaccggggcaacctggggagagacacccaaaccggggaggggagcaa

SEQ ID NO: 41253 - DNA, 1279 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttgtctccgtgaggtgccacgctccccgggatacag

SEQ ID NO: 41254 - DNA, 1893 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccctcaaaaaaaaaccatacccaaaacaactttttgccgcgcttcgcccagagaaaagttttaacccatcttttggcgcgcgggcccttgttacgcgacccggccacagcggcacccgggaacccgggccggaacaggggggtcccccataaaagcgctgggacgggcgtggaacaccatggggtccgggcacggctcacaggccgacgtataacccacacggcataacaaaaaaaaacacgatactcacacacaccatcacgaccagcacgatatagacacacacagcgatacacacacaaaacgagcactacaacacacaagaagagaaggggagcggagggggggaggcagacggcgaagactgtgggcgtcgaggaggggggcaggtgaagcagggaaggggaggcggggcagcggggaaggagagagagtaagagagaggcaagaaaccaaacgggggcgagagcggccgcagagcgagcggaagagagagacaagagggcaacgaaagacgcacacgaaggaacacgcgcgggccaaagcgccagagggcggagagtcggaaggcgcaccacgcggggaccgcacaaaacagaagcaagcgcaggccagagacgggagggcaggcgcggagacagaggaggagcagacagagcacggaggacggagaggcagacaaggaagagcaaagggggcgagccagagcgcagaacgcgaacgagagagaggagacgagagcgagagggaaggt

SEQ ID NO: 41255 - DNA, 1124 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagttagcgcgtgctgtcctaagccctcga

SEQ ID NO: 41256 - DNA, 1474 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccaaaaaaaaaaaaaaaaaaaaaaaaaaaaaaaaaaaaaaaaaaaaaaaaaaaaacaaaaaaaaaaaaaaaaaaaaaaaaaaaaaaaaaaaacacagacgagctaaacaaagcaaacaaaaagagagggggggcgcggataaaagataccccagaggggcgcgcccagtagtagagtaccccgaaaatcggcgagacacaagggggcccccaaagagggagccgcacaaaacaggcaaaagccagcggacgggagattacaaaccggcggacacggggaaacagcggaaccggggcaacctggggagagacacccaaaccggggaggggagcaa

SEQ ID NO: 41257 - DNA, 1176 bp, Homo sapiens
  misc_feature (1100)..(1100): n is a, c, g, or t
  misc_feature (1103)..(1103): n is a, c, g, or t
  misc_feature (1132)..(1132): n is a, c, g, or t
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagganagnaattctagcccctgttcgaggtaattaanatatgggggaggcaagccaccctgctgtcctttattgaattctc

SEQ ID NO: 41258 - DNA, 1361 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactact

SEQ ID NO: 41259 - DNA, 1057 bp, Homo sapiens
  misc_feature (13)..(13): n is a, c, g, or t
caagtttggcacncggggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41260 - DNA, 836 bp, Homo sapiens
tgaaagctcctctctctacgtatgattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41261 - DNA, 924 bp, Homo sapiens
  misc_feature (95)..(95): n is a, c, g, or t
cgtgatctagaggatcccagttcgacggagactctctctgtagcatgcttacagagagaggagctgtgagaaaataagtgtcctatttcttaccntgccagttgggtggatgctgacctcattcaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41262 - DNA, 1389 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatgtgagtaatactccatgcctactctgtcatgattgtcgctataccttttactgtgtgacactcctctattggggaatgccagatgccacttaccagctgtgactctggcttagtcatttaatctccaaactgtgaaaggaggtaatccctacttcattggtttcttgggaagatgagaggaaatgtgtaaaagcagctagcccaaatgttggcatatagtgttcaggtttctccgtctccttcacagcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41263 - DNA, 1477 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatgtgagtaatactccatgcctactctgtcatgattgtcgctataccttttactgtgtgacactcctctattggggaatgccagatgccacttaccagctgtgactctggcttagtcatttaatctccaaactgtgaaaggaggtaatccctacttcattggtttcttgggaagatgagaggaaatgtgtaaaagcagctagcccaaatgttggcatatagtgttcaggtttctccgtctccttcacagcttcctgtcagcgtttttgagtctgtcattgatataatcaatggagaggtaataccctacccttcaaccctcagatcctgctcttggcctctttcctgcttttgattctccctttgtgggttaccttgccctgtaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41264 - DNA, 664 bp, Homo sapiens
gatctgaggacccccgggagccttaacttatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41265 - DNA, 659 bp, Homo sapiens
taatcagccggtacccagaaacagctataccaagcacacagacttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41266 - DNA, 815 bp, Homo sapiens
ctgatcacacgaggggtctcatggccataagccagacggcatcagctcagaaacagagacttgcgtgtcacaggctcgtgttgttagcgcgtgctgtccggacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactact

SEQ ID NO: 41267 - DNA, 862 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41268 - DNA, 1142 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41269 - DNA, 1176 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggggtgagtgttgggcatagactccagtctcttctccttgctcacctcccccaggcagtggtcttttccccttcctctactggagccaattccccctcccccaaatcatcgtttccccaatacatggttcccactgatctcagaccctcaggtcatagaagtttctttaccctcaccttttccatgtcattctctttcccagtgattggggctctgattggcaagcaggagggccgaaatatcgaggtgatgaactcctttgagctgctgtcccacaccgtggaagagaagattatcattgacaaggaatattattacaccaaggaggagcagtgtgagagtggaatagatgtggggaagaggagtgggagttaaaaaaaaaatgtacagggtggggaagatggagagggttggaaagaaacaggagaggagaccaagaacaggggagaaaaagtgaagagtagctggagagatctcagaaaaagaaaacgttcagagttctttctcaaaagaaagcaaaggatgagaggagacaggatagaagggagtagttattctaaactgagccaggatttgaggagggaggagagaagctggtgaaaatacaccaggagcttcacattgaggaaggatggtttaaagaattactatgtcaggccgggctcagtgactcatgcctctaatcccagcactttgggaggccgaggtgggtggatcatgaggtcaggagttcaagaccagcctggcaaacatagtgaaaccccacctctactaaaaatacaaaaattagtctggcatggtggtgcgtgcctgtagtcccagctacgcgggatgctgaggcaggagaattgcttgaacctgggaggcggaggttgtggtgagctgagatcatgccactgcactccagcctgggcaacagagcgagattccgtctcag

SEQ ID NO: 41270 - DNA, 1421 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactact

SEQ ID NO: 41271 - DNA, 1244 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccaaaaaaaacaaatcaccacgcaacaccacacacacaaaaaaaggggggggcgcaaaaattacaccgagggggcacaaacacaccagcttttgtaaagggcca

SEQ ID NO: 41272 - DNA, 1504 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcacaaaaaaaaaaaaaaaaaaaaaaaaaaaaaaaaaaaaaaaaaaaaaaaaaaaaacaaaaaaaaaaaaaaaaaaaaaaaaaaaaaaaaaaaacacagacgagctaaacaaagcaaacaaaaagagagggggggcgcggataaaagataccccagaggggcgcgcccagtagtagagtaccccgaaaatcggcgagacacaagggggcccccaaagagggagccgcacaaaacaggcaaaagccagcggacgggagattacaaaccggcggacacggggaaacagcggaaccggggcaacctggggagagacacccaaaccggggaggggagcaa

SEQ ID NO: 41273 - DNA, 1092 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtactgaaacatgtaacttggagaaaatttaccagggagcaataaacttccgtacgaatagcct

SEQ ID NO: 41274 - DNA, 1098 bp, Homo sapiens
aaccacatagggtcagtacgaggccggctgtataattcggcaccgaggcgggatggaggtggttgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41275 - DNA, 930 bp, Homo sapiens
ctccacccgacggggtgggtagtgtggggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41276 - DNA, 812 bp, Homo sapiens
gcgaattcactagtgattagagactgcgagaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41277 - DNA, 1230 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggtaataccctacccttcaaccctcagatcctgctcttggcctctttcctgcttttgattctccctttgtgggttaccttgccctgtaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41278 - DNA, 1094 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatgccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcaccc

SEQ ID NO: 41279 - DNA, 911 bp, Homo sapiens
aggaagggggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggtacgtgtccggccacgtggccggacacgtatctgaacacacaatagactaagacccaaagctgggattagataccccactatgcttagccctaaacctcaacagttagacaacaaaactgtctcgccag

SEQ ID NO: 41280 - DNA, 1041 bp, Homo sapiens
gtttaaactgctcctccttggtgtaataatattccttgtcaatgaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctgcttccacctaagtggtctctgttctacactttaatgtcaccctctacatcatcttacctagcccacccaaccttataaacatgataattgactact

SEQ ID NO: 41281 - DNA, 663 bp, Homo sapiens
tgaggttgcagtcagatggtggctgtggctgcgaccatctcaaaggcttttcactcacatacctgttgcctggtctgggaagactcaagcagtttggggctgggacagctgcagttctccgtcatctgtttatgtgtacattttccatgtgatctctccaatgtggtgccttctgggttactgcactaagtataggttgactcagggctcccacagcgcttgtcccaaaagagaaccaagtagaagccattttgcctttctgactgccccttggaagtcacacagcatctgccacattccgttggttgaggcaggtgggaaggtcactctaggtacaagagaacatagaccccatgtctcgatagaggagtgttaatatcactttgtaagaaggtcatgtgggatgagatatatattggtgctatctttggaaaatacagtctgctacaagtaaaacccgttcagaattctaattggattttttgaagaaatcttatttttaaatgcatttggattacctaagttaaacttcagaaagaagagaaaagggaacttttaagcttctaagccatagtactaaaagcaaatgatgtctgcgcaaaaacaggtaatagacaaatgaaatagaataatgatctcagagaaagacccatatacatacgg

SEQ ID NO: 41282 - DNA, 428 bp, Homo sapiens
tattaagggagaggcttgtgtcttttttcccaagcaaagccaaatagcattcaatgagagttcactttggtgatgtttaatgaaaatctaactcagatagaggcctcactggaatactccatgaacagaaatgtaatctgggcaaaaccctgcaggctttatcctgggaaatgtaataaaaaaaaatcagaatattgtctctattgctgaatcagtagcctggaagtcactgcagaagttttacctgtgggaggctatgggaaccctcttgtgtcatgtgctctcaaatgtgaatgagcgggccaagaactaagaatattcaaaagattttaaatgtccaaataggcagttctggaaatacctcaacattgtttggatattacatttgacatgaaataaaaaggcatatgaaatactttgaaaaaaat

SEQ ID NO: 41283 - DNA, 396 bp, Homo sapiens
tttatttatttatttctcgagatagagtcttgttctgttgcccagactggagtggagtgcagtggtatgatctcggctcactgcagcctctgcctcccaggttcaagcaattctcctgcctttgcctcccaagtagctgggattacagacatgcgccaccacgcccggctaatttttgtgtttttagtagagacggggtttcaccatgttggccaggctggtcttgaacttctgacctcatgatccaccggcctcagcctcccaaagtgctgggattacaggcataagccactgctcccagcattaggcaatcccatttaaaatagtatttaaaaatacttaggaatgaatctaaccaaaaaggtgaaagatctgaaaactataatacattgatga

SEQ ID NO: 41284 - DNA, 1115 bp, Homo sapiens
tagaaaggtagagccagtcttacctactgtagaaaatgttaggaaggcagccaggcacagggtgataaaaccaatgagatgatcagggctaagaacagtaatcaggttttccacatcttgctggtgttggcataagccaggaaagtttcagtgtggccacatggggtattttctaataattaaaaactcgtcttcattctctcttcttggttacattcctatcccatgcgtcccacattccatgaacctttcttcctctagaccactctcctatacgtgtggacacctccccaagaaagagcatgtcagaaaggaagtggtctttgatttatgaccttgggctgtgatttgggacagatggtctcaagagaaacagctggaaactgccaccacagcatctctttgaggacccccatggattgctgtgcgcagaggagaccccatgggtaccactcaggctgccaatggccccacacagtctctacctttcctggggagctacggagcaggctctgggtttggcattttgcttctgtccctcgagtgaaatgtgcctctgcttcatttctggaagatcgggtttgtgatttttgtgattctgctttagcccaggattcgagggatcatgtccacatttgtaggccatccagggagcagagagaaacttttagggccgtgataaagacaagccaagtggaaaatagcctgtgccctcattggcacacctggtgtctttatttccattagccctgattgatcaagcgttgctggtctgtgggcacttcacgctcccagagagaccagattggagctgtcctgttgaatctggcctgtaccagatcatcactggagagtgggagggggcgtcttgttagattcctaggtaacccctgtccccatttctaacatatcactttccagtatttcccaagagcctgaattaatagttaactagctgctggaaatcaaaagttagatcttgagaatactaagttgataagtcaggcttggccagtatccatatgctgcatccacagcaaatagagtggccatttattgggcacagtctctccatggcgggtgtgcaatctgaacccacaggagctgttttgctc

SEQ ID NO: 41285 - DNA, 569 bp, Homo sapiens
acgtggtgccgctgagcttggaccccgaccagaagatagagattgaaacgatgaggaaaacgaatgccgtaatccccgctggacgctaactgcagggaacatggaggagacatatttccacctatttctctccataagtataaaagaccataaaagaccatctagggacttcagaacccaaataatgacacaatgatgagaaaggggaggctcagagaggggaagtaactgctgcatagtcacacagctggagagtgacaaggtccatgttcaaaccaagggctgatgccaaagtccaagcttgaaccacactgcaatgctgcccatttgtgcactattccatctgcgtatccagcagcaaaatacaattctgctcagaataatgaacctaatgttctgaaggcaccagaaggttgtggaagtattgacctatctctagttagcatctgctcaccaggacccctgagactgtggagggggtaactcagcagaaggaccagggctaacagggactgaatccttaccacataccagggcccgttccaaacactttgcatgttttaaattgc

SEQ ID NO: 41286 - DNA, 499 bp, Homo sapiens
aagcactgctgcatgttgaactggtgtggccgtggtttagtgacctaagccctgaatagttagacgttctggtcgctgatgacctaagaaaggagaagagttaattcaaacattctgaagagaaagaggaaggaaaatacattctgtggcagcggagactgccagaaaagccaatgagctgatgacctgagaaaacaagcagggctctaggggggcaatgccagtccaagaaacattacatcctgctaaaattagaacagataagcttacctcctagtacagagtcttcaggatttaggttatcattgagggctgacctgctccacaggtagtgaaagagaaggattagtttgtacagagtgcaggattgtgtgatgatgaaagagattaagttacagtttccccttactattttctattattgttccatattttgtctgtgagttttctcttctattttaatgtaaacaataataataaaggtcctcactccctgtaa

SEQ ID NO: 41287 - DNA, 372 bp, Homo sapiens
gttttaaagaaaatttatgctggtggtttgcagaaagttgacatatatcctagggttcccttgtcagagggcagcagggtccccatgggttcacatcgttgcctggacaaggagtctttgtaccctagtggtgcctgggttgtcgcagggatggggtaactcatttattcacactctttctcctttcctgtttccttcaaagataccctggtcctagttgactctactttactgttcaaaattcagctcaacatatgtcaagctgtacgttcttaaactcaaggaaacagaaaggttataaccccgtggtttccaagcctggcttttcatcagagtctcttggtgaacttttagaaaatccatattcttgcc

SEQ ID NO: 41288 - DNA, 452 bp, Homo sapiens
gagtgggctactgaaaggaagcattgatcttgagtgttggagaagagaagaatgccttcactcttaggctatgttatgatgtgtgcacacttgggctaagacttccccaggccagaaaaaagtaaaaactccataagggagtgaacggcattttcaggaggacagacaagtcttgaaaactttgtatccccacagcaaagtggagagaactcagaacctcagaaagccatcagcaagtagtggtgctagttagctctagattaaactgctctgcaactgcttcaagaaattttcaagccattcttgaaaaaaccaaatgaatgtatagaacccccaaaatgaaccagatgatgtctagcattctttggggaaaacaaccaaaactgttactcaacaattcaagctgtccaggcgtggcggttcatgactgtaatctcagcactttcggaagc

SEQ ID NO: 41289 - DNA, 139 bp, Homo sapiens
atgaattaataaaaactatcatcattttgtcttatgagaggaacacaggtccagctccctgacagaatatcaaattaatggcaataatttcataccattaattggaaattaaattcataatgattaatacataaaaaca

SEQ ID NO: 41290 - DNA, 503 bp, Homo sapiens
tgaattgtgtcttcataaaattcatatgttgaagccctaacccccaatgtgactatatttggagatagggcctttaaggaggtaattaaggttaaatgtggccatcaggggcaaggtcctaatccaatagggctggtgtcctcagaagaagaggagacaccaggtatgcagagcacagagaaaaggccacgtgaggacacggtgaaaagttgaccatctgcaagccaaggagagaggcctcaggagaaaccaggaacaccttgatgttgtacttctagcctgcagaattgtgagaaaattaatttctgttgtttaagccactgtctgtggtattttgttacggtagccctagaagactagtacaaggaaggggcacctaattttccgagagcctgaccaccagccccttctgttctgtccttccttctaacacctgcttcccctgattaccttaaatcacatacctacctccttggagatgtacctgatttcttcctaatctt

SEQ ID NO: 41291 - DNA, 486 bp, Homo sapiens
catcggctattattatatcactgattattattattatccatgctggggtatagagtgtcagggcagagccctttcctctgaatgctttgtaaacatcagtccgtcttcttttatttatttatttatttattttggagacagggtctcactatgttgcccaggctggagtgcagtggcacaatctcggctcactgcaacctctgcctcatggtttcaagtgattctcctgcctcagcctcccgagtgtaggtgggattacaggtgcctgccaccatgcccggctaattttttgtattttatattttttagtagagatggggtttctccatgttagccaggctggtctcgaactcctgacctcaagtgatctgcccacctcagcctcccaaaatgtagggattacaggcgtgagccatcgcgcccggccttttttctattatattttatttccctattatttgcatatggggctactggatctgttct

SEQ ID NO: 41292 - DNA, 459 bp, Homo sapiens
gcaggtaagatttgctaacactcacagtcctctctacaccaccaggtgatcccaaggtaggtcttaggtcttcagagcccaagtcaaacagagcactgaagaggtaatgcgagccaatgaggcccaggggaaagtcacttagtccttataggttgacacctgccaaggagtttgtaaagcccactgcatgataaagacagtctcagaagccatcactggcataaagtgggatgtgtacttcctggcccttgagcttagctccaccagtggtagtcaaaggcagggaagcagaaagagaagaacaactcttgcagtggctgggctgctgccagggcaggcagtgggggtcgtggggaagggaggtttcacagtagagactgttctggtaagttttcctagcatagcagccagggttgcaaaaacgcaaactgctttgacttttcccttccctaaagtttt

SEQ ID NO: 41293 - DNA, 2708 bp, Homo sapiens
cccgtgccagcttgctcaggccctcagtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41294 - DNA, 2793 bp, Homo sapiens
cacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41295 - DNA, 1126 bp, Homo sapiens
ggccagaaaggggcaggctgaggctgggggaggggctcaagggagcccagctgggagggcccaggcaggcagtgcggagctggccgtgggctgcctaccctttcatctctgcaactccttcctccctgggcctcccttctggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggtaacttgcccaagatcacagagttgagactagtcagagcctggatttgaacctagtgttcttgcccactgaacgtgctgaagggcttggaagctggagaccgaagagaggcctgggtgggctcactgcaggccccatgtctgcccctccagcatgggtctctctgcttgtttcaccttccaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaaggtaaccgctgatcacaatggcctagggcagaggggcgcacagagcaacctactcaaaccacagtgcctcctttgagctctgattctatgatgggccgccctgcagccttccattgtgcatgggattccatgccttcaaacatgtgccccttccaagcttggctgctctgcaggagaggcagggaacaagg

SEQ ID NO: 41296 - DNA, 218 bp, Homo sapiens
tcgctattcatcggcacctcgctattcatcggcacctggccacacagctgcacacctgctcggcagcacgctgtcctgggcccaccttggggtccaggtctggcagagggcagagtgtccccaggtgcccaagatgaatagcgaggtgccgatgaatagcgaggtgccagatgaatagcgaggtgccgatgaatagcgaagtgccgatgtatacgaag

SEQ ID NO: 41297 - DNA, 2791 bp, Homo sapiens
ggccagaaaggggcaggctgaggctgggggaggggctcaagggagcccagctgggagggcccaggcaggcagtgcggagctggccgtgggctgcctaccctttcatctctgcaactccttcctccctgggcctcccttctggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41298 - DNA, 1594 bp, Homo sapiens
atgccaggttggatggaggtcccacagcaatagaagcagcaacagcaggtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41299 - DNA, 1383 bp, Homo sapiens
aactacggctaggtgcgggtcgggtgttaatcggccgaggtctgctcgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41300 - DNA, 1933 bp, Homo sapiens
cccgtgccagcttgctcaggccctcagtcccagacgggcttttcccagagagctaaaagagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttggtgagcctcccttgcccgccacacccagccttggcctgggcctcccctcagacactggcctcagttggggagaagagtgctcagcaagtactgccctcagagtttgtctgggaatgctctggggcagcagcaagaaggagggacccccctgccttccctgcccttaagaagcttattcaggatgggggtacaggagccctcgggaaattgagtgtgtaccctccacatggagatgaaccctgggtgccaccaagtattcacatgggggtggacccaggtctggaggtgtcaaattcaaaatggtacattcctggctgggctcagtggctcacacctgtaatcccagcactttgggaggctgaggcaggtggatcacgaagtcaggagatgaagaccagcctggccaacatggtgagaccccgtctctactaaaaatacaaaaattagccgggtatggtggtgtgcacctgcagttccagctattcgggaggatgaggcaggagaatcgcttgaacccaggaggtggaggttgcagtgagccgagattgcacactgcgctc

SEQ ID NO: 41301 - DNA, 437 bp, Homo sapiens
gggttggctgggtgtttgctgagtgactcacagaaagtccgtctctctcagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaa

SEQ ID NO: 41302 - DNA, 854 bp, Homo sapiens
tcaggctaggtagagcctggtgttaagtcggtcgaggggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccgtataaagcccgagatcttgaaatgagtgcaccttcaacataactcttccgactctgaga

SEQ ID NO: 41303 - DNA, 2820 bp, Homo sapiens
cacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41304 - DNA, 2694 bp, Homo sapiens
gggcgggcagggcttgggagctctggggcaggcgctgaaggcaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41305 - DNA, 3026 bp, Homo sapiens
cccgtgccagcttgctcaggccctcagtcccagacgggcttttcccagagagctaaaagtaagaaagtaaccttcaggattaaagagaaatgtttctttgtttgggttttccgtctttctttctttttttttctcttttaagcctcttttcacatctgtagtggctttttttttctctcgcctggggtcaaaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggtaacttgcccaagatcacagagttgagactagtcagagcctggatttgaacctagtgttcttgcccactgaacgtgctgaagggcttggaagctggagaccgaagagaggcctgggtgggctcactgcaggccccatgtctgcccctccagcatgggtctctctgcttgtttcaccttccaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41306 - DNA, 616 bp, Homo sapiens
agaggtaccagacacctcctcttcataatatccaagctaaaaactacaaaaatatctggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaagcaaaa

SEQ ID NO: 41307 - DNA, 1188 bp, Homo sapiens
cacaaccagccacccctctaggatcccagcccagctggtgctgggctcagaggagaaggccccgtgttgggagcaccctgcttgcctggagggacaagtttccgggagagatcaataaaggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaagggtgcagagcagtactctgaggaatatccgagggaacctcctttgacgggaacaggtggggaagaagttacccaactccaagaatggctcctggctggggcccgcgctggctgaggacctgcgtctacattcccacgacagagtccacttccagggaagctggtgttcatctcactcgacaggagaggcgctacaacaggggccacagccgggggggggcgtcaccaacacaagaggggggggagccacgcaggtgctcactagcgcagcgcaggtccgaacg

SEQ ID NO: 41308 - DNA, 449 bp, Homo sapiens
gtcccctccttttctttagttatttcaccactaagtcatgacttcctgttagaggcttccagttctggcagtatttggttcctatttcacaagaagccagtctgttacattgtggcttttagtgctaacaagaaatcagtggtttagggtctttggccaggagaacagtgtaattagaagttaaactgaggtttaaacagtaatttaaccccacccaaattttcacaccaaatgagaattctaacatcaccttgccaaaaaaaaggtacactcttcaaagtgttagcccctaaaatgttagactgatcaacattgtaagtaaatataagagatgaaagttattgtcagataattacctccaggacagataactgactcggaaagtctttagatttgagatctcttgagctatgacccttataccaaattaggtaaagagcttacggtac

SEQ ID NO: 41309 - DNA, 562 bp, Homo sapiens
ggccgcggaagcagggagcacgggcgggcgccgggcttgccaccatcgccatcttgcagcgcccgcgtcctgggccggcccgagccgctgcgcggagcctctctttccctcgacccggctgcaaaggcagagtccgtgcgcctgagccccgggccgagactggagcgttctctggcggcctccaagggcgccggtgtctggaagcccggcctgggccagatcccttttgctgtcgtctccgtgattgccgggacagaattcccttccagtggggaaaagggaaggcggtcgcgcccttcccggtgccctgagtggggaggtgaaaccctgagagttggggcaagagggcctggagctagggccgaggcggcgggtgcgcagggtgttccgttgagcccgagccccccctcccccctccccggcctctccaccgtttctgtaggagcgcggcagggagcacacgtccctcgggaagaaaacggcgctggcggctgggcccgcaccgcggccgtcctcgctgagctcctagcgcgtggcctttgcgcgtctgtgtacccgtctg

SEQ ID NO: 41310 - DNA, 2344 bp, Homo sapiens
ggtcttgcgcatgcgcgggccgctgcgtgtgcgcgagcgccgcagtctgctctccccgcccgcggcccgtgcagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41311 - DNA, 2527 bp, Homo sapiens
gcagagcctttccgcagtttccctgcccacagcacacaccctgtgccctccgccccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41312 - DNA, 2430 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagagaaaaaaaaaacaaaccaatgtgcaacactttaagtcaatagaaa

SEQ ID NO: 41313 - DNA, 2385 bp, Homo sapiens
  misc_feature (44)..(44): n is a, c, g, or t
  misc_feature (46)..(46): n is a, c, g, or t
tcgactggtgcagactcagcacatgtgcgtcatattacggtgcncntcgccgctgtgtcaaggactcgtgagccccggagcgcaggctttcagatgagttgcacgcgcgactcacgaagacctagagtcactttgtggtcttccgagaccaaattatagggacagctgggtactgagcgcgtcctgacgacacggcacgcaggattcatgcgctgggggcatctcctgaacgataataatagcgtttgtaataagtctgaatttcattggtctgtgtgaagcctgagcctcatattaatgaagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41314 - DNA, 2507 bp, Homo sapiens
ggccgcggaagcagggagcacgggcgggcgccgggcttgccaccatcgccatcttgcagcgcccgcgtcctgggccggcccgagccgctgcgcggagcctctctttccctcgacccggctgcaaaggcagagtccgtgcgcctgagccccgggccgagactggagcgttctctggcggcctccaagggcgccggtgtctggaagcccggcctgggccagatcccttttgctgtcgtctccgtgattgccgggacagaattcccttccagtggggaaaagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggccctgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41315 - DNA, 2417 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagagaagagccagcgtgcccagcaaatctattctg

SEQ ID NO: 41316 - DNA, 2036 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41317 - DNA, 2580 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagaggtttataaaaataatttgtacttaatcataataaaaaacttcagggggaccctatcccaattcccttatataattcgtttacaattacttgcctcttttacacttgtaactgaaaactcttccttaccaacttatcccgttatcaaactcctgtttccatttctttataccaaaaaccctcaccattccctttc

SEQ ID NO: 41318 - DNA, 2369 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggccaccccctccaccctcaacccattttcctagggtttgtgaaataaacttggtatttgtttgggtca

SEQ ID NO: 41319 - DNA, 2241 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatgggcctgtgcaacacagagcccgttcctcaggcgagtggtggtgaggtgctctgtggtgatgggaacggc

SEQ ID NO: 41320 - DNA, 2015 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41321 - DNA, 1870 bp, Homo sapiens
  misc_feature (1803)..(1803): n is a, c, g, or t
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctgcccccgcaagacggtggcagggcngggtatgtgtcccggagccaggccagcgtggtcttgttcggggtggcactctggcgacttgcggggg

SEQ ID NO: 41322 - DNA, 1408 bp, Homo sapiens
acaacaaaaccagcaaagcgcttcagttcaaactggacacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41323 - DNA, 1369 bp, Homo sapiens
tcagccagcctgccgagcagagcagggccgtggggtctgtggttcccaggcagggccccccacagggggttccagtgcccagccacctcccctccgtacccagccacagcactcaggctgcactgaccatgcctgtgctgttcccagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41324 - DNA, 1695 bp, Homo sapiens
  misc_feature (26)..(27): n is a, c, g, or t
  misc_feature (57)..(57): n is a, c, g, or t
  misc_feature (91)..(91): n is a, c, g, or t
caggacttcggttcgagctttctgtnnattattcagcctccaaatgcaaatgaatgntataaaaataagtagggaacatggcagagagtgntgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgtgcttgatcggtcatttgtgtagatgagtaattaatatctcgtgccgaattcggcacgaggcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41325 - DNA, 1121 bp, Homo sapiens
gctgttccttcctcctgcatctcccaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41326 - DNA, 1175 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41327 - DNA, 907 bp, Homo sapiens
  misc_feature (82)..(82): n is a, c, g, or t
cttgccaggccgattaaggttgggttaacgcaaggtgttttcccaagtcccgaacgttgtaaaaacgacgggccaattgaanttgtaaatacgactcactattagggccgaattggggtaccggggttccaaggcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41328 - DNA, 684 bp, Homo sapiens
aaccaccgagccgcgagccgctaactctggcgagagctgctacctgaggggcaagctgctaactcagggccgagcactgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41329 - DNA, 1268 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccaggcgggcgggcggagcagcggacggcgccgaggccgccccacgcgccgggctcgcggcggcgcagcgcgccggagtggtcggggcccgcggccgc

SEQ ID NO: 41330 - DNA, 1186 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtgcgtcggccgcagctccacgcctgtgtccctccctgtgtctggcgctgccgctcttcagctgtgcccaggaggagaggcccggggcggggtggggctgctgcaggtgtcggtcccaacccaggacaggactgagtgcgcacaggcaccagggcccgggagtcccaggcgtgtgccctacgtgcacggacgtcacagcacacgtgggtctcacacaggcacacacagataacgtacacggatgccacagcacacacagcctcacacagacatcacagcacgtgggtctcatgggcacatgcagataacacacacggacgtcacagcactcacatgggcttcatgggcacatagataacacacggatg

SEQ ID NO: 41331 - DNA, 465 bp, Homo sapiens
acaggaggcagagcctttccgcagtttccctgcccacagcacacaccctgtgccctccgccccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccaggtaggtcccagacagcagtcccgggtgtggcagatgcagtgaggtccacttctgaggcgttccctggagtctgtgagttctggtcggaccttcgatggcattttaatgtgtctcttgtgtttgatttttagtaagactttgaccccgacgcaggcttcagtgattgccgcggatcagaagcctgagcactttggctcgaga

SEQ ID NO: 41332 - DNA, 271 bp, Homo sapiens
gaagccttcatgtagcctctcccagtgtccgggctggtgcttggggaacaagcctgagggccacaggctaatttcccagccggggcagccccacccccgaaggccaagcccgagggtcttcaggttccgggctgagcctgtgtgctttctcgctgcaggtcctgaacgaggctgtgggggccctgatgtaccacaccatcactctcaccagggaggacctggagaagttcaaagccctccgcatcatcgtccggattggcagtggttttga

SEQ ID NO: 41333 - DNA, 230 bp, Homo sapiens
ccaggccgcctacaggtgggcctcacggatggaccctctcccagcaggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgta

SEQ ID NO: 41334 - DNA, 2191 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41335 - DNA, 2139 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccgtctgtcctggggacgtggagggtggcagcgtccccgcctgcaccagtgccgtcctgctgatgtggtaggctagcaatattttggttaaaatcatgtttgtggccgaacgggcccctgcacccg

SEQ ID NO: 41336 - DNA, 2386 bp, Homo sapiens
ggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttggtttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 41337 - DNA, 1562 bp, Homo sapiens
taggtctatctatcttgttcctcgtagcatctggccagatctgtgcaaattcaccaactacagaaagtgaaaagtttcccaaaatatgcctattaacctcgaggaatgacttctctttttgtcatcaaagtggatgaagttttgtttgccttgggtttggcaggcagaaaacaacttccaggttgagctctcccctttacccagaagccactggccttcagttcctttctatgttgcacaaggaagtggcccaccttgcaggctttgctgatgagcttttatacctgtttaattgtgtgaattgcataaacacatgcaatcattagagtatagttgctctctcaataagtcttccagatggttctcttcctttccagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggaaaaaaaaattg

SEQ ID NO: 41338 - DNA, 758 bp, Homo sapiens
agcggattgtgcctgcgctgccagcagccaggagccaggagccaagagcagagcgccacatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaagagcccacgtcctcagggacggtcctgccttgggacctttgcacttgctgttttctgtaattggaatgctctttgccagaaagctgcaagcctcgaccctcttttccttcaaatccctgcttcagtgtcaccactgcatcatggagggcctatttaaggcgaaaccacaatttctccaaaaggtgagttgtaagagtgatcacttgtcttaaaaggaggacaggcagtctctgcccaatggggctgcatgggttttcggcatgacctctccctcccctggccacgtgggacgggcaaccatggcatggccaggagccctcatgccaggacagctgtgagaccaggaatcagcatcaccttgggacatgatggtacttggcaagatttaacatgaagctgtggggcattgcccagttagagctgagaaaatg

SEQ ID NO: 41339 - DNA, 1530 bp, Homo sapiens
caggctgtacaggtcccagcgtcgtaagatggagccaagagcagagcgccacatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggaaaaaaaaattg

SEQ ID NO: 41340 - DNA, 1607 bp, Homo sapiens
caggctgtacaggtcccagcgtcgtaagatggagccaagagcagagcgccacatgaacttgggggtcagcatgctgaggatcctcttcctcctggatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtgacaccatcccgctaaagaagagagccccaaaagctgcaagcctcgaccctcttttccttcaaatccctgcttcagtgtcaccactgcatcatggagggcctatttaaggcgaaaccacaatttctccaaaagagatgcacaggtgattgagctgtaggtgagcagtgacgtgaagaggggttctagccccgtggaaaacagcccatggttaacatctcaggatgttctgcattcaaacacccaaggctggtaatgaactttcacatggactgaatattggaggcaaataatagaaggaatagaatatacagtgcctctgtcctgaaggaaaatatcatgcctcttctggaagaaacggactgcacagaggaaggattgagcaatttagcctgcagtggaagaaggtggacaccaaaagcttcaccctgtgttggagctgttcatgcttccatgaggccatggtgtccatgtccgtggaacctaccacagaaaatggctcatgaaaaggggaatccgacccaacacacagcttcctacacactgccatcttatcaacagttaggcactactttgtagaacgattagcttcaccctcttagctgccaggagatcccttcttaaagatggactatgtgaagattcgggagtcctgaaacatggggactccgggatggtctctagccctatcgatgatgaacactggccttctggaggggaaatggcagtctgggctggcgtggtaggaagggctttggtgttcatggaatgggcctgctgctctcagaccttcaaaggatggaaccaacgaaggaccaaatgagaaagcagatgctgtgccttgcagagggccatgaatgtcagttattatttttctccttatacaattattttgtggttattattacaatgtacatggctgttgcatagaagacatgactggtggaggctgaggaaagccatgacattctacaattgccatcaggctaaggccccgtgagcatttctctcccttgtaatattaaccctgtatttctgggatcacatcacggaatattctttgcctttccactttccaggaaatctctcggactgggctaccctccttgtgtgtgatgaaagatgagctatatttcagaacaaagtgctgtgttgtcatgatttgcctggactcccagggcgtctcttacccaacttgataacgatgctgttcattagcagcctttgttaactgataaccaagagcggtaatgtgatactcataagcaattttctgtgtgtaggataaaataaaccatcttgtatgggaaaaaaaaattg

SEQ ID NO: 41341 - DNA, 652 bp, Homo sapiens
atctggtcttgctgggccattgctctagaacctgctcagtaattagcacttgttgagtcaattatgcccgaagtggaacatcagcctctggagccagtctgcaagaatgggacaggtggcgtgccatcctaagaagagaggacagcctctgctgaggccccgggcaagggcagcatggactacaggggttgtgcaagaggggagaatgagagatgtaggaggagctcaagtgctggcaacaggcaagacccctggggctgaaattgatttcaagtacgccctcatcgggactgctgtgggtgtcgccatatctgctggcttcctggccctgaagatctgcatgatcaggaggcacttatttgacgacgactcttccgacctgaaaagcacgcctgggggcctcagtggtgagggatgtggtgctcgggcctggctctgccccacccagcgaggcaccgagggccactctgtgatgctggctacagcaagaatgaacccacaagcgcagagcccaacaggctgtaaaggaaggcagtgacctctgcatgtttctgtctctctcactaacccttttgcctctgtttctctttcttctgtctctatctctctctgtctctctatttgtgttcctttttctgtctccctttccatg

SEQ ID NO: 41342 - DNA, 690 bp, Homo sapiens
gatgagcagaaagaacacctggggggctgtaggcaggtgaaagatagttttattcagcagcagctcaaattaacagctttcttacactagctctcttatgaacagcttttcttacactgtccacctttatctcggcggtttgctccggctgtgtggctcccgcgacccccatgcctgcggcttcccagaaggctctcccctgccttcagggtcagcagcttaaccctttatctgggcatgtgcaagccgagctgtgtcctggctccctcctgtccagacgggacagctttggctgtctctctttctctgggcaccagtgcctgcacaagagccatgttgagccagggtgcgccccaagagcgcctgtacaacggtagcagggcaattataccttttacagacaacagtggctcagagccaaggatgtacttacacaaacaggttatataacaagtgggggtgtgcgcctgcacgccaaactcgctgagtcatgcaggcctggatatccaccttggcctacctccatgtaccttttcatgtgattacacacttagaaaattatttactggccaggtgcggtggcttacaccctgtaatcccagcaccttgagaggctggggcaggaggattgctctaggccaggagtttaagaccagccttaggcaacatagcaagaccctgtctctacaa

SEQ ID NO: 41343 - DNA, 491 bp, Homo sapiens
tgggactgtctgggcaaccatggcctctgaagtttgagctcatgctctgcccatggctgcagctgcctgtggtaagccgaatgaattccaggagggaagatgacagaagaggctcaaggctccggctctgttccctgctctgctttctttcagagcctggaattctccaccaagcccatcgctgctgcgtggctttctgggcgccgtgccaaggactcacactggactctgtattcagccccagattgcatcctgcctcggcgtttggggtggggcggcccagcagggctccccttgtgactggagtcagagtttgcctgggctcccctgaggcgggcctaggccggggtcgtgaggctgctccaacaagcagccccattgtatcccagcctgggagtgcacagagagcggctcctgtgatggagaagcccctgtgcctctgcagggtttgattccacccaaccaggcgaagccatgtggtgagcatgtgc

SEQ ID NO: 41344 - DNA, 1454 bp, Homo sapiens
cagtggccagaatcataagccctgaccccatccctagaaagatgaggtcccagcaatggccagagcatttctcaccagttctgtgagatagcacataaaaatagagttctttgggcaaaacttttgggaagcaatgcatcctacatgggctgatattcagcctgagctgttctcaagaggagagtggtactggcagtttatggctgaaatccattctgattggttggagtctatgctataccagttgttaaacattttgagtatcactcttgcatactgttactattatattttctctatatatagacagaaaggccattttagaatattaaaggctctgaaaatttctgcagtagacccaactgaaggttctattaaggcagtgtttcctaaatgtatttgacctcagtatcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttggggaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgctgcagggtaataagctttctggttggttttccttccaattctggaaaggtgtccacactaagacccttaactctagggcttgcata

SEQ ID NO: 41345 - DNA, 590 bp, Homo sapiens
aagaatagagaaagtgaaatagatgacatttggcttccatctcattccccaccgccctcgcccagcgtcctcttcccagcccttcattttctcttgggtaggggtgtgtctatgagagagaggatattgcttgttactgatggaagccagaatcctccccatttcttctcccgcaatccagactctcactagaatatctaaatgatgtcctctgaacttaagtcctttatttctgtatgttctcaaatggcagatccattcaaaaaattctggagccaattatttaagttccagataacaaggccgggcactgtggctcatacctataatcccagcactttgaggaggctgaggcaggatgggatcgctttgagtccaggaattcaagggccagcttttgacaaaaatagtgagaccccatctttacaaaaacaaacaaattagctgggatgatggtgcacacctctagtggctactcaggaggctgaggcaggaagattgcttgagaccaggagttggaggctgcagtgagctatgatgataccaccacactccaccctgggtgacaaagcaagaccccatatctttaa

SEQ ID NO: 41346 - DNA, 329 bp, Homo sapiens
ggaaatcctctgttataaggcacctgcactaagcgtgaagtggtatggtgtaatttgaagatgggtttagattagttaaaaatgtatattgtagccagggtgacatagcaaaacccagtcttaactaacaatacaaaaattagccaggtgtggtggcacacatctgtagttccagctacttgggaggctgaggtgggaaagttgcttgagcccgggaggcagaggttgcagtgagccgagattgcacccctgtactccagcctgggtgatacagcaagaccctgtctcaaaacaaacaaacaaacagaaatgtatattgtaagttctag

SEQ ID NO: 41347 - DNA, 460 bp, Homo sapiens
agcagtagaatataagagattgagtgctcttagcaaatcttttattaccccagcatagtctctagtggtgtaattctctattgatgtgaacatttctattacttatgatagagaatcagtacaaaagtttataaagcaaagctgaagtttgtcacttgtaaatggtataaaggacaaattagaaacagattttgatttcctaaaccatgtatttctcaagctgctttcttgtgaccattttatactacttcaggctcctgatttcaaatacatttttaaagcacctaaataggccaggcatagtggctcacacctgtaatcccagcactttgggagactgaggcgggcggatcacctgaggtcaggagttcgaggccagcctaggcaacatggtgaaacaccatctctaccaaaaatacaaaaaattaggtgggcgtgatggcacatgcctgtagtccca

SEQ ID NO: 41348 - DNA, 553 bp, Homo sapiens
cattttatggatggaccttgttcatactccggaaaattgactcaggtaccttacccagtaaactggcagaacttactgatctctatacctctggctgaaatgtagcaagcactcagaaaatgtttaagtagattaatgtattacatttcttaccagagtgactaagacccactaaaatttattgctagaacttcggcttaattactatgccttccgcttttggggtggcattgtcacatttagtagtctcagttgaaggtaaaaatttaatcaggtttagttgttttagtagtgtggcataatttttatatggtgaaattaaaacggtggaatctttaataactatcacccagtcaattctgtcctcaaatcatcctacacactttttcttccccatctctactaaaaatacagaaaattagccaggtgcctgtagtcccagctactcgggaggctgaggcaggagagtggtgtgaacccaggaggcggagcttgcagtgagccgagatcacaccactgcaccccagtctgggcgacagagcgagagtcgtct

SEQ ID NO: 41349 - DNA, 391 bp, Homo sapiens
ctatacatattaaaaatctttttaaaaaacttctggaaggaaggtattatctaattggacatactaagttttcagtgctgcattttgagcaaattaaagttggtcataaaaaatacttacctttggccggacacggtggctcacacctgtaatcccagcactttgggaggccaaggtgggcggatctcgaggtcaggagatcgagaccatcctggctaacacagtgaaaccccatctctactaaaaatacagaaaattagccaggtgcctgtagtcccagctactcgggaggctgaggcaggagagtggtgtgaacccaggaggcggagcttgcagtgagccgagatcacaccactgcaccccagtctgggcgacagagcgagagtcgtct

SEQ ID NO: 41350 - DNA, 381 bp, Homo sapiens
aaaatgagataatttgttttctatatcattacagttattttcatgtctggagctcttacattaagtttcttttcccaaagtgtataagttttagaaagaaggaaagagaaaaaccttgaaattaaggttttataatggaaacactgtgcgcttaactgttcttgtgcttacccatcacgttaatacagtggttctcaaactttgcctggttggttcccatttaagaattatgtaatgaattccagaactcaccatgaaacaaaattggtgaaatcacagttggagtgtaacagacagcaaattaaacttctgtaggcagtaaaatccatgcctacagaaatccgtgacttaccaaattgaaggtaaaaattggtcgtagac

SEQ ID NO: 41351 - DNA, 444 bp, Homo sapiens
taatttaaatttcaaaactgcttgaaaatatattgtatcttgtatagatgagtcataggacaaacatatagactgttgttctatgggaatgcttgctgtctcagcagctcaaatattaatgccttaataatttacttaataagccaaagatgtagtttgctgatagactgtatgttcatatacaagcctctttcctctgctctcccatgcctaccccgtctgcaacctttgtgccctcgtcaccctcctgtgtgcatgtatgagtacccggaatatacaaacctcatggaactatgggactctttgacctctatgataaaagatcttcggattatgcttacttcttgattatctttttggggaacatcttggcctagggatttggattattcactgcttctttgtacatacttcttagtttgttaacttctgcaacacagtctt

SEQ ID NO: 41352 - DNA, 206 bp, Homo sapiens
ccttagaggatgtgccttagcttcaaaatttctgacatgaagataaaaagctggaactgtatctgaactttttgtgtgtgtatgtgtgaagcaaaagctaaaaggcaccaatttaaaaactgaatttatcttcttagaagtatctgctgctcaataatttttgaaaataattttttcttacatgaaatgaaattaggaaaaaaaaa

SEQ ID NO: 41353 - DNA, 287 bp, Homo sapiens
tgattataaacctaactgcacttgctcaaaatagtcaagttagcctatcctttcctcccttaaatccgggtactttcttctccttactaattaatgtcctttgtagcacattttcccccaaaatagagcactttcatcagcattaaaaacctgttcaggttgggtgcagtggctcattcttgaaatcccagcattttgggaggccaaggtgggaggattgcttgagcccaggagtttcagactagtctgctcaatgtagtgagacctcgtctctgcagaaaagtaaa

SEQ ID NO: 41354 - DNA, 372 bp, Homo sapiens
gtaattttgtttttcaaagaagctgtgaggaaagaaggtgtatatacttatatcatttgttatattaaccctgttatttaccattttcagttctctttgttcctgtgggttcaagttaacatccagtgttactttcctactgtaatacagctttgctgtcacccgcttcctattacactgttactggtaaaccttacatttctgtatatgataggcccaacaatataattgcacattgagtatccctaatctgaaaatccaaagttcaaaatgttccagaagcccaaactttttgagcactgtcatgacactcaaaaagaattgctcactggagtattttggattttcagaatagggatgcataaattccaa

SEQ ID NO: 41355 - DNA, 562 bp, Homo sapiens
caaaaggcctctcacatagaattttgaactaaagtcacatattgaacaaaggatatttaaattaactactgaacaaagtaagagctcttcaaaagaaacagagctccctgccaagccccctaaaaatgcccccaggcctcttattcattcactaccattatttcagtttatatctaaagatgttttatttcttatctcattctcttcccaccacctagtggacacatagttggcacttactgcttgtttattgaattgaatggaatctagccccaagagttaaaagctattctctgaagaagaaaataaaagagaaataattttgtcagtgaatagaaataacaagtctgagtttctctcggcaatggaataaagttaggaagggataacacgtacagttggctctctgtatctgtggggttccacacttctgcatttagccaactgcggattgaaaatattcagaaaacaaggatagttgcatctgtgttgaacatgtacagattttttccttgtctttattccctaaacaatacagtataacaactatgtacatagcatt

SEQ ID NO: 41356 - DNA, 512 bp, Homo sapiens
gcagacacctgtaatcccagctacttgggaggctgaggcagaggcaggagaattgcttgaacccaggaggcagaggttgcagtgagctgagatggcgccattgcactccagcctggacaacaagagcaaaactctgtcttcaaaaacaacaacaacaacaacaacaacaacaacaacagatctcattatcttcacctcgtccttcctacaacctgtggggattatgagaactacaattcaaggtgagatttgggtggggacacagccaaaccatatcatatggcgttgactttgaagtcaggtagactggatttgaatcccaactatagcactaattaatgttgaatacgtattaggggttgttactctattaatggagttttactccagtcacgttaagtcatgtagctcaatggactgaagcatgtcactttattgacaaattaactctttcagtcctgactctttcatggtgtagctataaccacagtgggactccagcagccccaacc

SEQ ID NO: 41357 - DNA, 325 bp, Homo sapiens
acaatcttgagcttcaagtcagtggaaagaaatgtacaatctaattgaacacaaaaaaatttatagttcaaaacattcaaagtgtcagattggttgcataaattaaaagagattagagaagaggaaaatcagtggacttggagtgatcagcaaaggcttcaataagtaggtagaacttaatctgggacttaaatgtgaaaattgaccagcttggaaggaaaaagggaggtggtaccacataaggatgtgaagtcaagcagaacagcagaaatggataatgctaacggtatatgaagaccagcagtggctgctgcaggaagtagag

SEQ ID NO: 41358 - DNA, 365 bp, Homo sapiens
ctctctaaatgtgtaactgtgtgtattttaacgttgtgagggtaagggaacaagtatcagaaaaaggtactttccatgtgcttttgcttccagtgagatttcaagtaaaaagtgtgatgtcatccttagagcccatgccagaggtaaaaacaaacagaaacctgattcatggggaccatacatcaaaggcctaaaatcaaaagtgaccaaatgtgttcgttcttctctcaataatttaacatctttcagcccctttcctggctttataaaataagggacaaattccaatcctgtaaaacagacatttaagcaaagcactttcatagtatcattatcagaggcatatatctttgggcaagccactt

SEQ ID NO: 41359 - DNA, 892 bp, Homo sapiens
  misc_feature (733)..(733): n is a, c, g, or t
  misc_feature (774)..(774): n is a, c, g, or t
  misc_feature (824)..(824): n is a, c, g, or t
ggaggaagagagaggaagggtgagggtgaggcgtgtgggggcggctgcctgtgtcagccagggagctggttttgttctcctgtttcctgtttgctgggctccccctccgtgcaagagctggaccccccacccccaccctggcggaagccagatgggaagagtgaggctgccacgagctgagtcaggagagcttagggggagagcgggaaaggactgcagccggggagagcaggacgcgccatctccattggcaccctctcccgccccacttccatcgctagaaaactaaggattcggtgttgggaccactcctgccctgacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccaactgcagagaccttggaaaggatcaaccatatacaatgtccatttcctgccctctaacctggcaggggagcaaggcccagccaagttacagaaactgaggcttggccaggcgtggtggctcacacctgcaatctcagcactgggaggccaaggtgggcagatcgcttgagcccaggagtttgagaccagcccgaggaacatggcgaaaccccatctctacaaaaaatacagaaattagccaagtgtggtnggcacgtgtctgtagtttcagctactcaggaggcttaggtngggaggatcacctgagcctgggaggtagaggttgcaatgagcagagattngctctccagccagggagacagagtgagaccctgtcccaaaataaataaataaataagaataaaattta

SEQ ID NO: 41360 - DNA, 940 bp, Homo sapiens
ggaggaagagagaggaagggtgagggtgaggcgtgtgggggcggctgcctgtgtcagccagggagctggttttgttctcctgtttcctgtttgctgggctccccctccgtgcaagagctggaccccccacccccaccctggcggaagccagatgggaagagtgaggctgccacgagctgagtcaggagagcttagggggagagcgggaaaggactgcagccggggagagcaggacgcgccatctccattggcaccctctcccgccccacttccatcgctagaaaactaaggattcggtgttgggaccactcctgccctgacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccacctctgatggccaacaggtgctgctgtgtgcccagatcaagaatccacctctgcggaattcaaaaccgctgagggttctgggacagcagggaggagagaggtggagacgcaacatgggttttctgtgttcagactgcagagaccttggaaaggatcaaccatatacaatgtccatttcctgccctctaacctggcaggggagcaaggcccagccaaggagttacaagaaactgaggttggccaggcgtggtggtcacacctgcattctcagcactggaggccagtggcagatcgttgaaccagagttgagacacctgagaactggggaaccttctttgaaaataagaattccatggggggcggttggatcacaacagggtagggaagcacgaccggagaaggctacaatccctgttccaggaaggagcccctaataaaaataaaaaccctcgggaga

SEQ ID NO: 41361 - DNA, 783 bp, Homo sapiens
  misc_feature (592)..(592): n is a, c, g, or t
ggaggaagagagaggaagggtgagggtgaggcgtgtgggggcggctgcctgtgtcagccagggagctggttttgttctcctgtttcctgtttgctgggctccccctccgtgcaagagctggaccccccacccccaccctggcggaagccagatgggaagagtgaggctgccacgagctgagtcaggagagcttagggggagagcgggaaaggactgcagccggggagagcaggacgcgccatctccattggcaccctctcccgccccacttccatcgctagaaaactaaggattcggtgttgggaccactcctgccctgacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccaactgcagagaccttggaaaggatcaaccatatacaatgtccatttcctgccctctaacctggcaggggagcaaggcccagccaaggaggtaacagattcctccaacacnaaaccacaccttccttccccacccccaccacctccacacccagctgcctctgtggggacttcagggggagagtgcacacagtggggcctcaaaggttatgtagcttgaataaatgatcctccaggcctggggagcctctccgctccctcccccatttcctctgggaaaggaatgtggggtgggccccagag

SEQ ID NO: 41362 - DNA, 807 bp, Homo sapiens
  misc_feature (648)..(648): n is a, c, g, or t
  misc_feature (689)..(689): n is a, c, g, or t
  misc_feature (739)..(739): n is a, c, g, or t
ggaggaagagagaggaagggtgagggtgaggcgtgtgggggcggctgcctgtgtcagccagggagctggttttgttctcctgtttcctgtttgctgggctccccctccgtgcaagagctggaccccccacccccaccctggcggaagccagatgggaagagtgaggctgccacgagctgagtcaggagagcttagggggagagcgggaaaggactgcagccggggagagcaggacgcgccatctccattggcaccctctcccgccccacttccatcgctagaaaactaaggattcggtgttgggaccactcctgccctgacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccattacagaaactgaggcttggccaggcgtggtggctcacacctgcaatctcagcactgggaggccaaggtgggcagatcgcttgagcccaggagtttgagaccagcccgaggaacatggcgaaaccccatctctacaaaaaatacagaaattagccaagtgtggtnggcacgtgtctgtagtttcagctactcaggaggcttaggtngggaggatcacctgagcctgggaggtagaggttgcaatgagcagagattngctctccagccagggagacagagtgagaccctgtcccaaaataaataaataaataagaataaaattta

SEQ ID NO: 41363 - DNA, 288 bp, Homo sapiens
gacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccagtaagtcctttcaggtgcctaacttgcattcctcttgctgctagtccagtccctggttctaaggaaatggaatgactctcccctctcatcccccatggagcctctgatggccaacaggtgctg

SEQ ID NO: 41364 - DNA, 681 bp, Homo sapiens
  misc_feature (490)..(490): n is a, c, g, or t
tccactgtccccagcaagaacctgcgggagggtggcccaatggggagaaaactaaggattcggtgttgggaccactcctgccctgacctgccctgtgactccgtcatactctccaaaggccagaccctcctagaccagctggaaccaccatcaagatgtccccagccatgtcagactctggggccccaggcggagggcaaccagatgtcttcagctccaagtctggcctctcctcccagcaagcagccacctctgatggccaacaggtgctgctgtgtgcccagatcaagaatccacctctgcggaattcaaaaccgctgagggttctgggacagcagggaggagagaggtggagacgcaacatgggttttctgtgttcagactgcagagaccttggaaaggatcaaccatatacaatgtccatttcctgccctctaacctggcaggggagcaaggcccagccaaggaggtaacagattcctccaacacnaaaccacaccttccttccccacccccaccacctccacacccagctgcctctgtggggacttcagggggagagtgcacacagtggggcctcaaaggttatgtagcttgaataaatgatcctccaggcctggggagcctctccgctccctcccccatttcctctgggaaaggaatgtggggtgggccccagag

SEQ ID NO: 41365 - DNA, 441 bp, Homo sapiens
gaagcagaagtgtgatttccacatgaggcagcataccatcttcccccaaccacaccttagggtctgcaagagaacataaggagggggaagccctgaagttgtatcatgggacatgtggccatctctctctctttcccatttttgtgtcccctattataaaatggtctatagtcactgtttccacatcctcctctcccattctcaattttcctctccaattaggctgtctctgtccactgaaactgctcttgtccatctcagccagccatgggtcaaacccagtggtcacttcccagtccttaccttcctcccgtctcagccctgtttgtcacaataggtcctctctctttcttaataagctttcttcattcattctccaagacaccactctcaacccactcactgacgtgcatcctcatctttgctcaaatgacatcaagg

SEQ ID NO: 41366 - DNA, 448 bp, Homo sapiens
cttctaaagtgctgggattacaggcatgagtcaccacgcccggctgacacttttcaacgtattcatgcacattacctccctcatttaatcctatgctagggcagctagtatcacccctgcatttctgatgaatttgaggttcagagactgacttgtccaaaatcacagagcacgtgagtggccacagctaacctgaagccccctgttcccctgactcggcttcctcatgttgtgtagccgtggaattttcagggtgctggacaggccttcagtgtattttgggcagtgtcattcaggatagaaggagctgtgtggagtgattcaaatgctcagagaagctggtgcttctgcatgaagactgcaagaaaatgggattggctgcagaagaattttgctaattttatgtcttgagatacacggactctactttcaagattggcagtcattc

SEQ ID NO: 41367 - DNA, 384 bp, Homo sapiens
actaagcaatacattgttttagggttacatatgttgatatactataaataaaagcaaaaattcatattgtgattacctctagggcagtagttctcaacaaggggtgactttgccctccaggggatatatggaagtgtttggagacgtttccggttgtcacaactggtggtgatggtggtgatatgctactgtcatcttatgggttgaggccaggggtattgctaagcatccaaaatgttctggttaagaattatctgcccaaaatgtcaatagcgtgaggttgagaaactgttctaaagcagtggaggtgggcggatcacgaggtcaggagatcgagaccatcctggctaacatggtgaaaccccatctctacaaaaatacaaa

SEQ ID NO: 41368 - DNA, 1133 bp, Homo sapiens
aggcacatgccatcgacgcccagctaaccttttcaattttttgtagtgacaggttctgtgtatgttgcccaggcatgtctcaaactcctggtctcaagtgatcctcccgcctcccagagtgccgggattgtgggtgtgagctaccatgcctggcctacacgtgtaaactttgagatgcattttagatatccaagtggaatgttgagaggtcaggtagagattagagaccagagctccagggggaggttgaagctggagataaacagaggggagggctcaggatcgttgttaaagacttgatatagaccaaagctcagtgaggacagtgactgagtctatttattcacctctatatacctaggacaagcattcagttatgtatatctaatcaataaattaatctgtggctattgttgcacagtgattgtgatttagtacaaaacgaaatcactaactgataatttgctttattgttcaaaacaaaaaaaattgaaatctggtatgtagtttcttagaaataatttgctaatagggctgggcacagtggtgcatacctgtaatcacagcactttgagaggctgaggtgggcccaggagttcaagaccagcctgggcaacatgacgaaaccccatatctaccaaaaaacaaacaaaaaatagcctgacatggtggcgcacacctgtcccagctacccaggaggctgaggtgggaggatcatctgagcctgggaggttgaggctgaagtgagacatgatcgtgccactgaactccagcctgggtgacagaaaaaaaaaggaaaagaaaagcttttataataaagcttgacactgaaaagaatcttagaggccatttaatgcaaaggttcaaagtgtgcaggcaaggaatggtaaggggagtggacagtttattgcaaagggtgagcccttgtttacaggggccacatattgacaataaactgagtaacaatgtcttaaatgtaatggcaccactcttgttaaagtatatgaagatgttgttgcaattaataaagagaacatttttgttaatttcttgttattatgtattttcataaccagtaggctccaaaaagacagctatctttggagcagggaaaagctagtgcttatacattt

SEQ ID NO: 41369 - DNA, 851 bp, Homo sapiens
ccttcatatctcaatgctacagtctttaagcccctgttataagaactcggaggcttcagggatgacaggaaacaccagaacgctatggtggagcatatctaggtgccttctcccaactcagaccctttgactgtacaaagacacaggtttcaaggctgagatccacaaaactctagcaaatactgcacagacaccaaccaatgacagcaggtgctgcctgtcaccctggagcaccaggcagcatttcaaagcactcttgctgtgccggcctctgattgctggttatagggaggtctggggtagtcccaaaagctgggatgtccaaggtagctggggtcagtcaggaggctcagggcagtggcaggaaaatattttcctccctgttagagcaacagtggggtatccaggctgaatatcagtggcgagaaggatgatcgcacagcaccaagacctgcggaacaaactttgttggagctgaatccagaaaaacaatcttcttctaagccactctcctgcccctcatttaattattgtgcttttgggtgtacttggactactctgaaacattcagaactctgtcaaaaaaaaaaaaaaaagagagaaagacttctttcctcagcacctctctgacttgggcatcagtcttggcttcctgtctacttgctttcacttgctgtttgtggcagagatggcccccagcagatcccttccctcgggttcccttgctgtcaagtggaggctagggagcgagattatggccaataggaatgtgaggcggaagtgatgtgaaccacagatcttgagccttagggaacatcccatagggaccctggagcttctttcccccggct

SEQ ID NO: 41370 - DNA, 471 bp, Homo sapiens
ctcctcccacagacattcctgtggtccactggggaagtgagcagcctgggactgcagtggttaactccccaccaggctcaggagagaaggagtgtccaccctcagacccggtgggaatcaggatccctgacccctctacctttaactccaccagaccacatgagcacgtgaatatgttatgggttcaactggatcccctaaagaagatacactgaagtcctaatccccattacctcagaacgtgaccttatttggaaagagcgttgctacagagataatcaagttaaaatgaggtcattagggtgggccctaatccaatatgagtggtgtcctcatgaaaaaggggaaacttggccaggtgtggtggctcacgcctgtactcccaatactatgggaggccaaggcaggaggatctcctgagatcaggagttcaaaaccagcctggcaacctggtgaaaccccgtctctact

SEQ ID NO: 41371 - DNA, 777 bp, Homo sapiens
  misc_feature (697)..(697): n is a, c, g, or t
tgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagactccatctcaaaaaaaaaaaagagagaaaaaaaggntgatttacttaagccttaattttatcaaggcacgttttgcattttgcagttttcagtcttttctcctgcttagaactggg

SEQ ID NO: 41372 - DNA, 2652 bp, Homo sapiens
cgagagcctgaattcactgtcagctttgaacactgaacgcgaggactgttaactgtttctggcaaacatgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaaaaaaaaaaa

SEQ ID NO: 41373 - DNA, 368 bp, Homo sapiens
ggtagcaagattcagccattgcctttgtaccatattgcaaatattaaatgatagcacttactgctgggattgtacatggcagggactttttaagaaatgctcgtttccttcagtatctttttctcttcctaagttaccttgcttgtgtttggaacacttttaaaactcgtatatagaaaggcaaaaagttactccaaccctctcctttgtaacaaacccacacagaaggataagaaccacagttgcagctaccctggaacttgagttctgtcaagggagctgtagctgtttactttaaggaaggtatagggaatgtaatgattgtactttttcccacctccaccgggggtaatagcccaaggcattag

SEQ ID NO: 41374 - DNA, 355 bp, Homo sapiens
tgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaa

SEQ ID NO: 41375 - DNA, 937 bp, Homo sapiens
taacctgtcagttaaaaaataattactatgtcagtatggctggcagctcatataggaaaaatatgctgtctcttaatcaaaggtgattacagttttcccctgtctataaatgtgcttgttgtgtaacgagaatgcattagtctcagcctgatgtacgaaatgaaaggcagtaagaagcagcaccattgttatcactccagggcgtgtctaatgaatcgtgtttccatgttctctcggtcacgccgtagagtgccctcagccaggggcttaagcctccctgtaaaaatgctctttaagattattgtagcaagaacagaaatgctgcatggctgggggtggggagagaatgccaacgagacagctgcatttcaaacagttacagctgcaaggattactcatagtaatagcagtgacagacaactgtttgagctttagtgtaaaaggcaatttggggacttgccctgtcagaattttagtagcaagcttctgtgtgcacgtgtgtgtgcatgtgcgtgtgttttttattcaaattagtttgtgtctgaagagtggaaggaaatattttaaatttttacttctcaattgtgctaatgttgaaatcagtagttgactcatctttattaaaatcattgtcctagaggaagtttataaaatgtttatttgtagcaatgatgaatttaaatgtatatgttctaactgaatcacatgtctgcttttccgtctcaaaatttatcttgtgatgattcctgttttaaaaatattggttttccttgtaatttctgaacatacagccttgtttaatataggatccttattttaaaaatttatttcaaatatgatgtaagcttataaaagtaatgcctgtcatgaaatctggaaaatactcaaagaggtaaaggagaaaacaatcattattctagcagagataactgttaat

SEQ ID NO: 41376 - DNA, 391 bp, Homo sapiens
agcttttgagctaaattactcctagtttttagctctaaatttgtaagattttgtgattctcagctatagaggtataacttcctaatctgtcaaagaggaattggagacttactactccctagaagtgtgaatgactaaattccagtggtgcgagtggctgagtgagaaggaaaactgatcttacttagtttctatggaagaaaatgtgaattaagtgccatgagtaactggcagcatcccttttgagcccaagattttctttcccctatcattgctgagcctgctggagcatataattcctatccattaccatcctccttttctttcttaaaaaaagtatttttggctgggcgcggtggctcacacctggaatcccagcactttgggaggc

SEQ ID NO: 41377 - DNA, 874 bp, Homo sapiens
  misc_feature (35)..(35): n is a, c, g, or t
taacatgatacgaatcgagctcggaccctagtttnagaagtttcaatagcatgaaaatttgagttgaaaacagctagcagaaagctgatggcgcaaattcaaccctaatctcatgttttggcacttctgaactatagcaagcataagggctcaactcttatctagttgaagcttacttgggtctttgagaatagtacatctcaaaattaaacactttcttagtccttattgttaagttgtttttggaattattgtcttatttgtctgaattaagtgtgctgcaggacttataggatctgatggatgatttgcctaaaagttggtccaggtcaacctcagggcatttaaatgcttggtccagccactttctgaaagttgactgaaatatgttgcacagcagggtagaggaggacaagtttactagatgtcatttttaacctgcttgtcttcatctctgactgtagaaatgtatattcattataagtttgccacaaatagagaatagagtttattctttgatcatctaatttctaggagctattgaaatttctactgctacctgcttttaaataagcgccaacaaacatttattaaaagggctttaaggtataggccaagatttattcaattgctaatggtatgttttctgtaaatgaaagcaaaaatatgttcaagtgtataatattaaatattaacattcagaaacttggagaaatacagatggcttttttttttgagacgcagtcttgctctgtcgcccaggctggagtgcagtggcatgatctccgctcactgcaagctccacctcccgggttcacgccattctcctgccccagcctcccgagtagctggtactacaggcacccgccaccac

SEQ ID NO: 41378 - DNA, 182 bp, Homo sapiens
atcaacactcaacacagactagttttgatcgctgatgtgtatgggatttcccacaccaagcaactttgcagttctcagtggataccagctgggtgccctacagtttaactcaatttcgacacacctacctgaagttagaatcagatcccacaggttcagggctcagtcccacaaaactatcc

SEQ ID NO: 41379 - DNA, 486 bp, Homo sapiens
cctctcttaagtaaatgaaaaccctattgtttttgctaactaaaataaggttttagttatagtataattttataagtggatacagtgcttgaaatcacatttccattcttccagggctggtgatgacaaacaattccgaatcaacaactcactgaaattgattccaactttgtagaagaaagtgtcacacacagagtcagcccccattcatgtttccccaacactcagaatcatcctagctttgtctggtagatagagtgtcaagtagaaagtggataagaggtaaaggggtattaagtatttgcctaatgttaatgttaagctgctaatgaatgtcaaggataatttatcctccgtgtactaaaacaaccttttattgtttagatcactgagtattagatccctaaaaaggactttgggggttacttgggaaactcaggcatgctctccagttgttaccaaagccatccccagtctggggaggag

SEQ ID NO: 41380 - DNA, 427 bp, Homo sapiens
aataatctccattgctcagctatggtgaatattgcaaaagagggcataattacctctgagataagctgccgaatccattgttctacaagaagtcataaatgtagttgttagtcatcacaaaaatattttaaaatagtacttaaggctgggcgcggtggctcacgcccgtaatcccagcactctgggaggcccaggcaggtggatcacgaggtcgggagatcgagaccatcctggctaacatggtgaaaccctgtctctactaaaaaaatacaaaaaattagccgggcgtggtggtgggcgcctgtagtcccagctactcaggaggctgaggcaggaaaatggcatgaacccaggaggcgaagctcacagtgagccgagatcgcgccactgcactccagcccgggcgacagagcaagactctgtctca

SEQ ID NO: 41381 - DNA, 335 bp, Homo sapiens
tcaaactggaagtaaccataaatgccccaaaaggtgatttaaagccactgttccttcaatagcaaggaactgggagaaatataaacgctaaacagttagctggctaaacaaatactacttccatagaacaatgtaatttagctattaaatgagatttataatcacatggaaagttttatagtaaatgtgcaaaaagacactatataaaatgacatgtacagtctgattctatccttctaaatcttgccaaaaggtattcaatgggtgataaaaattttggatggtatctgcatgtgcttatcaatggtttttcaactatgataagcatgtactac

SEQ ID NO: 41382 - DNA, 451 bp, Homo sapiens
taatcttcaatatagaagtatttacagtattgtgcaggctgttggaactgatctaacagaaaagtgaaatttgagcatggaggagaaaaagggctaagtcccgacaatgttgtccctgtgcaaggagaacttttcagagcctatgcacaaggctagagggtgtccttagataaaagcccataccattcagttcattcacagcaaggaagaaaaagcagtgatacaagcacagagggagggctgtggactgaatcgtgcccctcaaaattaatatgctgaagccctaatcctcaatgtgatgatagatgaggcctttgggagataatttgttttagatgggctcatggaggtgggtcccttgtacaagattggtccccctataaaccaaagagcttgctctctatctcatcaccgtgtgaggacacagagagaagacagccatctgcaaagc

SEQ ID NO: 41383 - DNA, 197 bp, Homo sapiens
ccccaaatagtgctgaatatctcaaagtaatttgcagtcttattctttaaagaaaattgccatttgtcctctgagaatcacaaaattgaaaagcaaagatacctctttggctttgtaggtgctgttttgctaggcttggaacgctcctccctgccacaccccgtatccttcttgtctggcgagtgtgtgtgcctgtc

SEQ ID NO: 41384 - DNA, 325 bp, Homo sapiens
gtcttatcatgttacctaggctggtgttgaactctgggcctcaagcctcagcctcccaaagttctgggattataggcatgagccactgcgcccagctcttatcccttatagcacataccatgttttttagagtcagtggcttatgtgtctgtttccctcatgagattgtgaggtcccagaggccagggttattatatcttgctcatctttatgccccaagtgtctaaaacagtaggtactgaaggatcatatgtttaacagatccaaatcactgagaaactgtgacataaactaacctcctattcagacctaagaaaccacaggc

SEQ ID NO: 41385 - DNA, 235 bp, Homo sapiens
gtagctgggattacagatgtacaccaccacacccagctaaatttagtatttttagtagagacagggtttcatcatgttggccaagatagtcttgatctcttgaccttgtgatccgcctacctcggcctcccaaagagctggggttacaggcgtgatctaccgcacctgctgcaaccaggttttctgaaagttaaaaattctcagccagatgcggtggctcaacactttggggagc

SEQ ID NO: 41386 - DNA, 468 bp, Homo sapiens
ttattttccaaatgggaaaaagtcatttcatcacatcagcctgtaacttgacatgaaccttgcaaataagcattaaggccaaaaaaggtataaaacacccagaacagctaggccacttgtggctgcttcacagatctaggggcaaatccatgagctggaaagtaaagtcacattagttcgggtaagaagtcttttatttcttggcttctgcggcctgcaatcaggaattacctgaaattctttctggaaacaaaaaggcagagcatatatacattaattaaaatcaaagaagtcagtggtggaaggggtttgcttagcattctatggctgtcacccagtatgaatggatgttctctattcttaagcctgtgccttgtaatttaggaaaattatcattctttgtgaaaaatcccattggtgagctaatctcttaaatgccttcttttattttctgaaaacaaaaacaaa

SEQ ID NO: 41387 - DNA, 393 bp, Homo sapiens
aatgaaggatgtgaatgtataatcaggtgattattcaaaaataacattattggatttaaggttcagagtattttatagaaatttctttgacttgtagttatgaattatgacatggtttctaaagctggttcttcctgatttctttatgtttagctaatgtgtttctataagttatttaccaagttctaaaaattagttgtttttaaaacattagatgatatttattgggtatctatttgaagcagttgtctaaaaagtcaagttttattagatccattacccaaggctgacatgtatgattttagtcattgaatacatttcttctgtggagtagtttatctgctagttattataaagcactgacaaatactttttgctttttcaggactgtga

SEQ ID NO: 41388 - DNA, 196 bp, Homo sapiens
atctcaaaaccaaacaaaaacagttgatttttaacaaaggtgccagtggagaaatgatagtctttttaacaaaaggtgctggaactatgaaaaatgaacactgacttatactttgcattatatataaatatcaactagaaatgaatcatagccttaaatataaaacctaaaacaataacattctagaaaaaaaatt

SEQ ID NO: 41389 - DNA, 398 bp, Homo sapiens
tgcacgctacatttccaccaacggtttatgagggtcccagttttcacacaacttcgccaacacgtactgacatcctagcgagcgtcagtacttttcgtttataaagtgatgtaactgcttcttttaagcaactgacgtttgtaaagttggccttaatgttagtttgctctgcccttgaatttaagaaaccagcaaaactaatagcttatccacagttgcctcaacggcctagctgccaccttccgtgtgggtgccgcgccgtttgcacaggcatcatcctttaccgagatcctgcgttctgggtctgggtgtagtcaggtcaggctttcttcccgcagcgaagcttttagttgggcatctgggacgcgcaggactttcgcgctacctgcaggccgcag

SEQ ID NO: 41390 - DNA, 458 bp, Homo sapiens
tgtgtgccagacactgtgctaggttttagggaatcctgctctcgtggaggtgacattctgtgaggttggcaggataatgaagaggaacacaattctcagcacagagaaaagttctgctcaactggtgcaccccatttattctagttctttccagggcagagtcaccctttccccaaccccctcctttcagctctgtggctggggaaacagcccccaccccaacccaccacatcccttggaacaccctagggcctggaggcgctggggccctttcagaaaaacaccctgccaagaatgcatcaccccgccagggcgccgaccaaggaaaacagagggcctgaggagggagatcagacaggccctcaggccaggccattggaggggcaggcgcagcaggaaagccgagtcaggcaccaggtgaaatatgacctccaaagcatccataggcatttcttgta

SEQ ID NO: 41391 - DNA, 343 bp, Homo sapiens
ttagtgagatgcaggagatcggagatcagtgggagaaatgtggcatcttcatggtattgggtctttgaatccatgaatatgttgtagtcagggatttagatcttcgttaattctctgatgtcttattgtttcctgggtagaggtctttcacatattttattatatttgtcccaaaggtactcactattttttatgctattacaaacagtacctttaaatttttactttcagctgggtgcagtgcacatgcctgtagttacagcactttggaggccaaggtgggaggatcacttgagcccaggagttcaagaccagcctaggcaacatagcaagaacctgtctc

SEQ ID NO: 41392 - DNA, 438 bp, Homo sapiens
ttctaacttaacttctaacattagcggccggacgcgcgtgtcacgcccgtactcccaaagtgcagggattacaggcatgagccactgcactcggcctaaaaaccactttttttgtttgtttggtttggtttgagactctgtctaaaaaaaaaaaaggtagacaccaggcacggtggctcacacttgtcatcccagcactttgtgaggccaaggtgggcagatcgctttaagcccaggagtttgaaaccagtctaggatacatggcgaaaccctgtttgtacaaaaaattagtcaggcgtggtatctcacgcctgtagtccccactacttaggaggctgaggctggagaatcccttgagcccagggaagtggaggttacagtgagcagcgatcatgccactagactccagcctgggtgatagaatgagaccctgtctca

SEQ ID NO: 41393 - DNA, 993 bp, Homo sapiens
atgtaaatcacacagatgttggtagagaaaaaggcatactggtattgaaactgtaaactggcctgtttacttcgtctcctaacaaaaaacactttggattcaggttctccacagcagtcttccactggccacagtgaggggagctaggtttccccagtctccagctagaaaaactcagaacatctaaagatctgaaagatggaaaaaagagaactaaaggcttctgttccaaaatttgacaagattccttggcttagtgaggccagccttgtaaacaagccattagtgctcagccttcccagaagatatcctcatacctctgcgacttttctgacttcatccaagaagaatatgaatttgccaattttgtttcaagttccagatgttttatctaaggccaggaggaaccagtgtgactccatgctgctcagaaaccaacagctgtgctccacatgtcaagaaatgaaaatggtacaaccaagaacaatgaaaatcccagatgatccaaaagcatcctttgagaattgtatgagttatagaatgagtcttcatcaacccaaattccagactacacctgagcctttccatgatgacatcccaacagaaagcattcactacagactgcccattctgggccccaggacagctgtcttccacggattactgacagaggcctacaaaactctaaaagagagacaacgttcttccttgcccagaaaggaaccaataggcaagacaacgaggcagtgagcggtaggagctcatcacctcccagactcccagagagaaaataacctcgccaagccaatctttgacactggcaccttctcctcacaattttctctcttctcccaaaagatgatttaattttgccttcctaagattgctggtattctagctcttacctctatgttctttctcacgtctcctaaagacaaaattgtttaatttacatgattataaagatctgtttatgaaaatggaaaaataact

SEQ ID NO: 41394 - DNA, 880 bp, Homo sapiens
atgtaaatcacacagatgttggtagagaaaaaggcatactggtattgaaactgtaaactggcctgtttacttcgtctcctaacaaaaaacactttggattcaggttctccacagcagtcttccactggccacagtgaggggagctaggtttccccagtctccagctagaaaaactcagaacatctaaagatctgaaagatggaaaaaagagaactaaagatatattccaagcacacagaacagtatttgtcatacagcctgaatccttgtgccagcagcccacaaagaggcatgccacagtatcaaaattaagccaattaataaccctgcaatggcttttaactgttcaaatgaagagttgcacatctctcattttaaatcaaaagtagaaatgattaagcttagtgaagaaggcatatcaaaagccgagacaggctgaaagccaggcctcttgtgacaaacagccaagttgtgaatgcaaataaaaagttattgaaggaaattaaaagtggtactcccatgataagaaactaaaagagccttactgttaatacagataaagttatagtggtctgtataaaaggctaaaccagtcacaacattccctttaggccaaagcataaaccacaacaaggcgctaactcttctcaatttaacaaaggctgagagaggagaggaagctgcagaagaaaggtttgaaactaagagaggttgattcatgaggtttaaggaaaacagccatctctgtaacataaaagtgcacactaaagcagcaagtgctcatatggaagctgcaagttatccagaagatctagctaagaacattgatgcaggcttccattccaagatggccaaataggaacagctccagtctgcagct

SEQ ID NO: 41395 - DNA, 679 bp, Homo sapiens
atgtaaatcacacagatgttggtagagaaaaaggcatactggtattgaaactgtaaactggcctgtttacttcgtctcctaacaaaaaacactttggattcaggttctccacagcagtcttccactggccacagtgaggggagctaggtttccccagtctccagctagaaaaactcagaacatctaaagatctgaaagatggaaaaaagagaactaaaggcttctgttccaaaatttgacaagattccttggcttagtgaggccagccttgtaaacaagccattagtgctcagccttcccagaagatatcctcatacctctgcgacttttctgacttcatccaagaagaatatgaatttgccaattttgtttcaagttccagatgttttatctaaggccaggaggaaccagtgtgactccatgctgctcagaaaccaacagctgtgctccacatgtcaagaaatgaaaatggtacaaccaagaacaatgaaaatcccagatgatccaaaagcatcctttgagaattgtatgagttatagaatgagtcttcatcaacccaaattccagactacacctgagcctttccatgatgacatcccaacaggatctgtccacaacatatggctgaagactttccatggagatggggtacaaacaaaataaaagttcccctattggc

SEQ ID NO: 41396 - DNA, 435 bp, Homo sapiens
ggcttttttctcagtctatggttgagtggttttcacattcctttgagggtactgagttcttacagtttaatcacaaggtcaccataactcccacttagttctttaaaatgtagcatttcctcaagggttggtaaaaagtctttactaaagatgatatccagcctgggcaacatagtgattattgttaaagagtgagattatgggtgatttagatttccttccttatatttttctgaattttccaacttttccttttatgataaattgatattattattattattattattttgagacagagtctcactctgttgcccaggctggagtgcaatggtgtggtctcggctcaccgcaacttccgcctcccgggttgcagtgagccgagatcgtgccattgcactccagcctgggccacaggagcaaaactccatctca

SEQ ID NO: 41397 - DNA, 7084 bp, Homo sapiens
  misc_feature (160)..(160): n is a, c, g, or t
atggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaanttaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaagttgctgcacctgtcgtttccgctcggtctgatgctgatcactctggctctgaccctccttctgctcctgctttacatacctgtttcttagtaaatgaaggttggagtcagttagctgctatgcactgtgttatgctgccagacctactgggattggataaatttaggcctccccttctggagatgctggcccgaagatggcaagatcgatgcttggaggtgagagaagccgcacaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagcggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattgggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagcggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctcacaataaaacct

SEQ ID NO: 41398 - DNA, 5388 bp, Homo sapiens
aacaagatttagccagatgaacctcttgcttccctcttacgaagttattaaaggtgggtcactgacctaggtggtttctgtggagctgttgatgtgcttctgggatcaaccgtctcgttcttcacatttcatattcccagtaagtatgcagtgccattctcacaggcctttgacaaggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcacaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagcggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattgggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagcggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctcacaataaaacct

SEQ ID NO: 41399 - DNA, 3256 bp, Homo sapiens
  misc_feature (160)..(160): n is a, c, g, or t
atggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaanttaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcacaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactgaggcacagttgaatgctgttgatgctttgattgactccatgagcttggcaa

SEQ ID NO: 41400 - DNA, 191 bp, Homo sapiens
cctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggtatactgaagagctccgtatgtctaaagtgttttgacaactcttaccc

SEQ ID NO: 41401 - DNA, 6985 bp, Homo sapiens
  misc_feature (160)..(160): n is a, c, g, or t
atggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaanttaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcacaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagcggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattgggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagcggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctcacaataaaacct

SEQ ID NO: 41402 - DNA, 3604 bp, Homo sapiens
  misc_feature (160)..(160): n is a, c, g, or t
atggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaanttaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcacaggccctgcttctggcggaactgagaagaattgagcaggcaggcaggaaggaagccattgatgcctgggctccttacttacctcagtacatagaccacgtcatatcacgtaagagttctcatgcttctctacaaagctttgcaggaatatgtagaaaaggtacctgtactcacaaatatatatgctactacccatcaacaaaaatgagtcactgaccttaaagtgaaaagaacagatcctcaaattcactttattattttctgaatctctgtagtttggaacttgctttaaaaaacaaaaggcaaaggctgtctatatcaaaatattcattaatgaactgacttttataaatgaattccccatcaaacatcctactctagtactaacatgtgcctccgcccattgcattattatgcttatggatgccagcttgttcgatatggatctgatgatatgcaagtgcagatacaaggcaaactctcttgctagttaaagttgggattgtgaatccttagaaaaacaaagatctgatagagttagactcaggcaatatttacaaagagaaaattgggaaggattttgatggataaatctttcaaaagagtataatttgaaaggatt

SEQ ID NO: 41403 - DNA, 1160 bp, Homo sapiens
cctccccttcctcttgctgcggttcttgacactactacaaaccaggactataaacataaacatgtgtcactgtaacagggcaggttcccagtagctgcagcagtgaaagacagtgattggctccagtgctcccagaaggatttgggctgaagccaggggaacagaaccagaagaggattccctttccagagaccatcaggctcctcatgtcttgtctctcctctctcccctcgtggtggctcaggatttcagtatggctgagcagcccatagagtcagctgacatggtcaacaaatttatcaaagaaaccccctggcttttgaagaatagtactttatacatctggatctgcacatcaggcaaagctcagaaatatccgtttattcttttaatcacgcggatgtgtctatttttggaggaacaaggaaacacataaatgcctgggttgcatttatgttgtagttgcaaacactgaacagttaagaagattttgccgaattttgcaaagcagccaaggagccgccttgggatcgtggtaatgcgactgggaggacccttgctctcatttggcaatattttggatatccttgaaaacgacaccaaaatttgccttaatttgactaagaagaggttaaaccacattgattttcatccaaagtgattttgttaaagcagatgcttgactttgatggaaaaactgggagttgtggaagatttacctaaactaccaaccaaaagcatcacaaaccactgaaacagtctgcatcgtacatcagcactttcttttcattgttattacgtaaaacctctggaagcaccttgggcgtttgacagtttcttttctttgctgcagaaggaagcaatctgctccctggaattctgacctgtggtgaacaggaccctggcaaaggctttgctggggactcttggacgatcccgcctccaatccagtacggttaattgtggaaaagtgtacacatttctggcttatctatgctttgttatgggtctgacgtgaaactacctcctccccaccccaccccccagcagagaaccgaaatccagttgaattgttacagtgtttcggagctggagccttgaactgcttccttggtcaaataactttgtttctggttgtaaaaaggcatttcaggaaaaaa

SEQ ID NO: 41404 - DNA, 1101 bp, Homo sapiens
tttttatctcccgcttttttgtaggttcccagtagctgcagcagtgaaagacagtgattggctccagtgctcccagaaggatttgggctgaagccaggggaacagaaccagaagaggattccctttccagagaccatcaggctcctcatgtcttgtctctcctctctcccctcgtggtggctcaggatttcagtatggctgagcagcccatagagtcagctgacatggtcaacaaatttatcaaagaaaccccctggcttttgaagaatagtactttatacatctggatctgcacatcaggcaaagctcagaaatatccgtttattcttttaatcacgcggatgtgtctatttttggaggaacaaggaaacacataaatgcctgggttgcatttatgttgtagttgcaaacactgaacagttaagaagattttgccgaattttgcaaagcagccaaggagccgccttgggatcgtggtaatgcgactgggaggacccttgctctcatttggcaatattttggatatccttgaaaacgacaccaaaatttgccttaatttgactaagaagaggttaaaccacattgattttcatccaaagtgattttgttaaagcagatgcttgactttgatggaaaaactgggagttgtggaagatttacctaaactaccaaccaaaagcatcacaaaccactgaaacagtctgcatcgtacatcagcactttcttttcattgttattacgtaaaacctctggaagcaccttgggcgtttgacagtttcttttctttgctgcagaaggaagcaatctgctccctggaattctgacctgtggtgaacaggaccctggcaaaggctttgctggggactcttggacgatcccgcctccaatccagtacggttaattgtggaaaagtgtacacatttctggcttatctatgctttgttatgggtctgacgtgaaactacctcctccccaccccaccccccagcagagaaccgaaatccagttgaattgttacagtgtttcggagctggagccttgaactgcttccttggtcaaataactttgtttctggttgtaaaaaggcatttcaggaaaaaa

SEQ ID NO: 41405 - DNA, 498 bp, Homo sapiens
gagccatacctgctcgtgccatccagaccagagcaggggaagctgggacttttgaatgtgaaaaaagaaattactgtataatttttttcttgcaggctcagaaatatccgtttattcttttaatcacgcggatgtgtctatttttggaggaacaaggaaacacataaatgcctgggttgcatttatgttgtagttgcaaacactgaacagttaagaagattttgccgaattttgcaaagcagccaaggagccgccttgggatcgtggtaatgcgactgggaggacccttgctctcatttggcaatattttggatatccttgaaaacgacaccaaaatttgccttaatttgactaagaagaggttaaaccacattgattttcatccaaagtgattttgttaaagcagatgcttgactttgatggaaaaactgggagttgtggaagatttacctaaactaccaaccaaaagcatcacaaaccactgaaacagtctgcatc

SEQ ID NO: 41406 - DNA, 419 bp, Homo sapiens
aatagatgtagactctaatgttttaactattggattctgcttaacaatatttcttaagcatggtgaagcacctaaaaaaatcaggctggttttggttgaatactatcctctttgtgaaataccaccctgaaatatttatatttttattttcataatagtcactcaaaataattttaccagtggaatgtgttcctattgtatatatcttttaaaactacaatcatgtatctagaggaaaaatctatttaagaataaagggctgtttcaattttcctaatattttgttatcatctagcacttgccagtaaacaaacgataatagtagtcaaagtattaaaatatatctaagaaattgtatgcattgttactatattatgtgactcaattatatgcagttttagcagtttaacactccagct

SEQ ID NO: 41407 - DNA, 581 bp, Homo sapiens
caaaagcacttgggtgtttcttattcagaggcaggttgggatactggctctgtgacctatagtctgtcctggcttttgagggaaattttcttattagcttggttccttagtcctgagggaaaagtgctcacctccaaaaattaggcaagcgtgccttttgtacattgtgactaatcagctaatcccgtattttcccacattgagattatctttctagagccccacatggaaactccctaaatccactggcatttgcaagaactccattcattcactcactgactcattcattcaaaagatatataagtgcttcagtggtgccaggcactgttctaggtactggattatagagtgaaccaaacacaacccctgcccttctgtggcgtataaatgagaggagaaagatagaaagcaaaataaaaatcagataatgataagagctatgaagaaaagtcatgcagggccaggtgcagtggctcatgcctgtaaccccagcactttgggaggccgaggcaggaagattgcttgaggccaggagttcgagactagcctgagcaacatagggagaccctttctctaca

SEQ ID NO: 41408 - DNA, 449 bp, Homo sapiens
acagtgtggaatggtgagcaaagcacataggctctggggtcagggccgatctggaatcttgacttagcctgcttactggctgagggaccacaggcaacatgctcaactttcttccgctttagtatttatatgaaaaatcagaaaatgcctacaactcacaaggttacatgataccatgggtaaagtacatacaaatgttaattctcttgacctgtcttcaaagccccatggctgtttttcttttttttcagatggagtctcgctctgttgcccaggctggagtgtagtggtgtgatctcatctcactgcaacctgtgcctcccgggttcaagcgattctcctgccttggcctcctgagtagctgggactacaggtgcgtgccaccatgcccagttaattttttgtatttttagtagacacggggtttcaccatgctggccaggctggtc

SEQ ID NO: 41409 - DNA, 849 bp, Homo sapiens
cctcagaaaccaaccctggcatatatggtccgatgatcttccagaaggatgccaagaccactcaatggcaaagcacagtttcttcaacaaatggtgatgggaaaattgtataactacatgcaaaacaatgaagttggactcttaccttacaccacgttaaaatcaattcaaagtgaattataaacctaaatgtaaaactagaactatcaaactcctagggaaaacaaatttggaaaatgctttatgacgatgaatttgtcaataatttttaggatatgacattaaaagctcaggcagtaaaagcaaaaatatatcaaacctaaaaacttctgtacctcaaaggtcacaaccaacagggtaaaaggcaaactgtaaaattaaaaaaaataccagtttagtgtcccttatttgaaatgcttgggatgtgtttcagattttgtaatatttgcattattcttactggttgaggatctcaaattcaaacacctgagtctgagatgctccaataagcatttcctttgagtgtcatgttggcacttcaaaaagtttcagactttggagcatttgggatttcagatttttgggatcagagacattcaacctataggttgcacatcatgtatctcataagaagtgaacattcagaatgcgtaaagaactcctacagagagactaccagaagcagagaggagcaaacacattttcacactagggaacctgctatctctcctggattccaattagggcagagtaagtgctagttctctgccaacccaggattaggccctgcagctgcagtgaaaataatcacagaagaaaactaagaaataaaaaatggagaaagtgaga

SEQ ID NO: 41410 - DNA, 470 bp, Homo sapiens
taaaatactggcaaaccgaatccagtagcacatcaaaaagcttctccaccacgatcaagtgggcttcatccctgggatgcaaggctgtttcaacatatgcaaatcaataaacataatccatcacagaaacagaaccaatgacaaaaaccgcttgattatctcaatagatgcagaaaaggccgtcgacaaaattcaaaagcccttcatgctaaaaactctcaataaactaggtattgatagaacgtttctcaaaataataagagctatatatgacaaacccacagccaatatcatgtggaatgggctaaagctgttgacctgatagatatgggttcaagaggacacagctgaatactgtgcttaggaaaagaacagtttcaaaggctttccagattgtcagatttgatgatatcctccttggtgcacacctctcttggctatggggcacataaaccacctctaccaatcta

SEQ ID NO: 41411 - DNA, 1197 bp, Homo sapiens
taaaatactggcaaaccgaatccagtagcacatcaaaaagcttctccaccacgatcaagtgggcttcatccctgggatgcaaggctgtttcaacatatgcaaatcaataaacataatccatcacagaaacagaaccaatgacaaaaaccgcttgattatctcaatagatgcagaaaaggccgtcgacaaaattcaaaagcccttcatgctaaaaactctcaataaactaggtattgatagaacgtttctcaaaataataagagctatatatgacaaacccacagccaatatcatgtggaatgggctaaagctgttgacctgatagatatgggttcaagaggacacagctgaatactgtgcttaggaaaagaacagtttcaaaggctttccagattgtcagatttgatgatatcctccttggtgcacacctctcttggctatggggcacataaaccacctctaccaatctaactggtttgtgcagtttttctgattttgtatctaccggcaaaatatatcttaagccatttttaggaaacaggaggtttagtcacgtgctcaacaaaagcacaacaaatggggagcatttaatggtgtaagggctgtgaggtgtagctgctgaaactgtagctaggagctgccttgctgccttcttgcaggcagattggccagatgagccaggctaaaatacaattaatatctaccattgtggtttaatatgaaatatggatacctggtctttgtctcagttcttgtcatagagttccccaaacctttagaacttcctgagtggtaggaatatctcattagtgataatgagcccctttgattcgataactcctgagtttatgctaatgaggttacttaatgtggggccctagatattcttaggatggggctagttcccggaaagaccaggtcatttgaggattagagggttggaacttttagctctacccactgatctctgggtggggaaggtgctggagatcaagctgcctaaaaactcttgaacaacaagatttgaggagcttccagtaaatgcgtccacaagctgggagggcactgcaccccagtttcactgggacagaagctcttgcacttggaatctttccagacctagcccttcatgctgcttcatctggctgttcatctgtatcctttataataaattggcaaatgtaaaggttagctgaa

SEQ ID NO: 41412 - DNA, 329 bp, Homo sapiens
cttaatagattaatatgttgtgtttatactccagttacgtttgcattcactagagcagaacttagaatgggaaatacttagctggcaaggaatttattctagttcatatctgaaagtaataaaactgtagtaaaatgttttcagtgattcagttatgtaatccacattacctcttacattcccttgaaaatcagtgattgcagatatcaaaaaaacgggagattttctggtggccctatttatcttgtgtcttatccttcagtgagtgaggctttaccagatagcagttatatctctttctaaagcacatttctcttttcttcttaagc

SEQ ID NO: 41413 - DNA, 267 bp, Homo sapiens
gtcatggtgcaaatgagttcctttgcctctccaagcactggtccttattaacctggaggtgactgcagccacaagaaaaactccctaaaagctttgctggcaggaggtgaaagagaagatgcaccacgcctggaacatcctaagtgctcaataaatggctgccgtgggtggctgcttccccaagccctcctccttcaccacagggttcttgtaaaattcctaactgtccttggaggcctaaattccctgctgtagccatcctgatgc

SEQ ID NO: 41414 - DNA, 426 bp, Homo sapiens
gtagctgggactacaggtgttgcaccactacgcccagctaattttaaaaattgttttgtagagacagggatcttgctgtgatgcacaggctggtcttgaactcctgggctcaagtgatctgccctccttggcctcccaaagtactgggattgcaggagtgagccaccacgttggcctcattgtagccatttttaagtatacagttcaatgacattaagtatattcaaattgtgttgcaaccatcaccactatcttcagaactttttcatcatcccagacaaactctgtacccatttattttcaactgtttttaagtgtacaattcagtggtattaagtacattcaaaatattgtataaccatcagctctggtgttagaactttttcatcattccaaataaattttgtatctagtgggcaataactc

SEQ ID NO: 41415 - DNA, 708 bp, Homo sapiens
caacagtggatagccaatcactaaccagtgttatttctgtaaaccaatgagaattcctgacgaacaacttttgtaatcacccgtcttctgattcatccttttttctgtaaaaagttgagcctgtcctttggaatactctccaaggcaacctggaagtgtctcaggctgcagtcttcaaccttggcccaaataagctaccttgacctgctgtttgcctttttaccctaattccccccaggcatccctagatagggaaacaagccacatctctgccctcagcctgggaccctgcttcctgatgatacctgcccatccctgttttttctccataaacttgctgggaaaggtgccctggttctgtttctctagaggctgtggtgccagactggaaactaccagtttcctgggcatgtgccttggtgtcaccgaacagccagatgagacttgtcaccagaaaatgctttcctttgctcctttattaaacacactcatattgccagtactggggatatcccctgagcaaggtgtaggagagcaaaagtagacaaccagataggaagaaaactgaagtggaataaatagatgccaggcacatgaatggtgctttttttcatcaaccttgtgacgttggaattatctcccattactcaagaagctcagagaggacaagtggtcttgacttatcagacatgggccccttttttgtta

SEQ ID NO: 41416 - DNA, 365 bp, Homo sapiens
tccctgaataaagtcgcacagagaagtctcacagagaagtccttgtgttgctgagctggtgaaacttgctggaaattcaccttctggaacttgccagaaatctaccatctggaacttgctagacatccactatctggaacttgctagaaatctgccctctgcatcttgctagaaatatgccttctggaacttgctggaaatagatggaagatgagggagtataatatagacaattcttcctagaagtgagaaggttgcttgtaaagacaaaagacaataggagctggaaggaaacagggagctgggaaagtttttaaaaattgaagagacttcaatatgtttaaaaagacaatggaaaagatctc

SEQ ID NO: 41417 - DNA, 403 bp, Homo sapiens
aagaatgaattcattcattcatccatattctgggagcaaaggaaattggagttaacaaaaccaacccagaaactgccttcctggtcctctatcaagtgcagcagaaggtcatggaacaaatgacttcaagagtgttacttgttactgaagggtcagtaagagataatgacctttaggatctatttttgcacatcaagggtgggcaaaagcaacccgcaaatggagtcttaaaaggtgcctaggtgtctgctggcctacaagggtgggaaggtgttccaggctgtgggcctggcttgagcagtggcctggaggtgagactcagcctggcatgcaccctcgagaccctcttggccacttcctgttccccagtgtgagttccagtgccatgagcagccctggcccc

SEQ ID NO: 41418 - DNA, 403 bp, Homo sapiens
ggtataaagcaaattttcacattttaatttcaatctccaagagaattagggtgaccaagagcattatccaatagttgtagtgctttaatggttaaattatttggtctatagtatctgtctactgctgagagacaggaaggcaacacatgttttgctgtctgtgtgtgagccaaataacagaagggcaatgaccaatcattgacagactttgaaggaagtgacgtgaccggtcactgatcacaatgtacatctgttattcacattgtaatatgtggactgaagaaactgagatgcagttactcatctgaataccaaggtaactgaaatttgagccagtttgttgggagactggtgttgttgaatgaaacatgacaactgaaatgttcacacattggaattgtgc

SEQ ID NO: 41419 - DNA, 258 bp, Homo sapiens
atcattttagaaaagataaaggaggaaataacaattttagagataaccaatattatgtactacgcctttatattttgctttctctgttgttttaatggatgacttgtctctatactttattaaagatcaacttcacttacatactcgatcccatcttctcttgcttgctcaaggattttgtctctcaacccctattttctctgtatcaacaatttctcccttcccaaacatttgttgccattaacatataaatatgct

SEQ ID NO: 41420 - DNA, 645 bp, Homo sapiens
gaaaggctgaggaatttctcagagggtgacggactgccagctgccctgaggttgctcttacttgttacagtggacaagctgctttgctagcgtgcagatggagaaggcgggcccgggaggcttggagtttggcccaggagctggcaggtgcccagcagcagtttcactgcccgcttcaggcgactctccactggcttcctgggagccttccgttaggagatgctctctcaagatccccgtcaccagggctttctggttggaatgaggcaaggacctgctttacacggtgcgccccattacccaacagcgtttcctgtccttgctggccacagccatcacagtggggctgtcatcagccactttaaacaggcaaaacgtatttacctgtcagggaaaataccaagatcacaaaggtggttttcccagggcaaggttcgtccattgcactccagatgtgctgacccctgcgatttcttcatatgtggggaactgcactcacactctccccagcaatacaaataaataagtaggctgggcacagtggcccatgcctgtaagcactttgggaggccagggcagtaagattgcttgaggccaggagttgaagaccagtgtgggcaacatagcaatacctcctctctacca

SEQ ID NO: 41421 - DNA, 117 bp, Homo sapiens
ttcaataaggtttttaaaggatgtcaaaggaaaaacatctaagtgagaaatgtttttgtggtattgaaagatgactttttctgttcattagctatatgtttttgacagtattttttc

SEQ ID NO: 41422 - DNA, 298 bp, Homo sapiens
acgatcgtctcctgtttctttgcattataattgcaaattttaatgttcctctcataagagtactaaaacataactaacaagaagacaaaaatgcagaaaggatataagatttgaaccatttcagtcaatttaagtggcctttagaaaacacaatgctaggcaaatacagaatatagattcttttgaagtgcacatacaacattcacaaaatagacagatgtgggactatagcaagtgtaagtaaatgtcaggaaactgacatgttaagacatcatattgagtatgttctcttgccaca

SEQ ID NO: 41423 - DNA, 316 bp, Homo sapiens
ctatatactaaagaagtaatgtacctaagagaaagacatggcccggcatggcatggtggcttgcgcctgtaatcccagcactttgggaggccaagacgggggattgcttgagcccaggaattcgagaccagcctgggcaacatggcaaaacctcatctttacaaaaaatacaaaaatcgtcagggcgtggtggtgtgtgcctgtagtcccggttactcgggaggctgaggcaggaagatcaactgattaagcccatgaggttgaggcagtgagctgtgctcataccaccacactccactgggtaacagaactcgag

SEQ ID NO: 41424 - DNA, 358 bp, Homo sapiens
caccaccaccccacccccacctcccgggaccatcggctctgacgctagtaaatctgcgcctgcgtcggcttgcgccggatgttcgggtttaggggtttggttgtcaatgggttttctcgtctctgacataaccacgaagttatataaatgctcctgaagtgtgggcatccggtggtggtctgagccttggagtttcctagatggttacctttctggaacacattatatttggagctaaaagggggaacgcttaaatttgtttccgtaattctgtcctgtcgacttctaaaactgagtacctaagttgtcttgaatttaccttcctgcaccatgtcagaataaaaaacgcagcgagtga

SEQ ID NO: 41425 - DNA, 499 bp, Homo sapiens
cacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggtggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcaaaaaatgt

SEQ ID NO: 41426 - DNA, 861 bp, Homo sapiens
gcagcatcagcttgggaaaagagtgcctttaaggcactgtttctctctatgaaggcagtgtggaatgatagggatgatctaggacctagaggagagaccttaagtcttacttgcagccaaaagccttcaaacctgagctagccagaactgttacatcagaattctcacccatgacaagaagcctggagggagtccagggttgatggattgacttaaggtgtcatcaaaagcttagactttacccttctgctgcaccacccttattgccttgttgtcacaagaggactactgctgttcaagtcatcacttccacattccagaaggaagaaaggagaggtagagggccagaagtatcccctccttttatcaggagccattaactttcccagaaacttccatgtccacccagcagacctccacttacatctcactaggcagaactcctatcacttggccaccccagcagtcagggaagctggaagggtgagcattcagctatagagagtggaagcacaagcagcaagggaagaacaggtcagtaattgctgtagagtttcctgcccagcagcatctgccaaaactaggtaaattattttttaacataatagtatttttgtggattttcttacaaaagcaatgcatatatattgttactttgaaaaataaagattttaaatcttcaacaagcccattactcaggagtgatgactgttattcttggtttattagctttctagatctttgtattttttttaacgtgggtagaaccacaatatgggttgctctgaaattagcctttacacttggcattgtgaaaaatctttccaaatcattaaatgttctctgcagaattaaaaatta

SEQ ID NO: 41427 - DNA, 428 bp, Homo sapiens
gggattacaggcattgagccactgcgcctggccagcaggtgagtcttttaagcaaggtgccagccagagaggatgaggattttataattgtgaggactgcaattaactcagtgtattcagtaaacattttgtgagcatctgcagcatgctgggcttgaggacacagcagtgaacagacatggtctttcttctcgtgaagactgccatttagtaagagtggcaactattaaacaggaccaggcatggtggctcatgcctgtaatcccagcatgggaggccaaggcgggcagatcgcttgagtccaagagttcaagaccagcctggccaacatggtgaaacccatctctactaaaaatacaaaaattagccgggcgtggtggcaggtgcctgtaatcccagctattcgggaggctgaggcaggtgaatcg

SEQ ID NO: 41428 - DNA, 110 bp, Homo sapiens
agccggccgagggattatgtaacttctggtgggcatggcagatggtgtgctggctcagacagtatcaaacccagcactgacactaaccttctctgacgtggcacccgggc

SEQ ID NO: 41429 - DNA, 446 bp, Homo sapiens
ttttctattgaaaggcctagaaataatgaccaaccagtagcaatgaaccttcatagcaaatagattatggtccctagttaccattttccacatgagggagtcaagtgttactgaagaaatggctgcttccaaaactagggaaggaaagtttcaagatgaaaccggagtatcttgtcatagcaaacagcacagaaatcatcatagaccactgacagggtatcaaaagggctcaggggccaactgcaggaagtgccccagggccagagatgggcaatatgaacatcaataattctgatggattgacatgtatctatcaaatacttcaaattcatgagtttatgttgacaagcttcccctcagaaaaagatctcattacatttggaggatactaaaaaagctaactcattatttttgagtacaaataaatgaaaagaatcaagcattta

SEQ ID NO: 41430 - DNA, 353 bp, Homo sapiens
cgatcctcctaactcccacccagagtgatgggattacaggcgtgagccactgcgcccagccaagcctgggatagaatcaggtggctctgagttcaaatccttcctctgtccctggtgtcctgggtgactctggggatgtcatgccccctctgtggcttccttcagttgtttgggctcatttgatttgatttgatttcatttatttttgagacagagtctcactctgttgctgaggctggaatgcagtggcacgatctctgctcactgcaacctctgcctcctgagttcaagcaattctcctgcctcagccttccaaatagctgggactacaggcgcctgccactatggctggc

SEQ ID NO: 41431 - DNA, 2129 bp, Homo sapiens
  misc_feature (31)..(31): n is a, c, g, or t
ccctggagttcctgtttcccgggacttccangaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactgctgtgtggcattcttggagtgtgctgtgaatgtgctttttaagaaattaaaaagagatcattttaaaattgaaaaaaagt

SEQ ID NO: 41432 - DNA, 2118 bp, Homo sapiens
  misc_feature (31)..(31): n is a, c, g, or t
ccctggagttcctgtttcccgggacttccangaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttaaaatgatctctttttaatttcttaaaaagcacattcacagcacactccaagaatgccacacagcagtggtttgctgctctttgtcagaatatgtcagtaaacaaaac

SEQ ID NO: 41433 - DNA, 464 bp, Homo sapiens
  misc_feature (31)..(31): n is a, c, g, or t
ccctggagttcctgtttcccgggacttccangaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatctta

SEQ ID NO: 41434 - DNA, 2175 bp, Homo sapiens
  misc_feature (31)..(31): n is a, c, g, or t
ccctggagttcctgtttcccgggacttccangaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggcacaataagagcagttgccaagatgaggggtgccctcttctcccccaacagctgttctgtaagccggctctgtatctctcaatctaaaagaggctaaactattcagtcgcaggggcgatcccagatccagagctctgtcccatcccgaacctacccaagttccccttcccagggtcattcggtcccagtcgggggggctgcaagaggaaggggtggcatcaataaaca

SEQ ID NO: 41435 - DNA, 188 bp, Homo sapiens
tctcagaggctgcctttggtttttttacatgtgaccttttccttaagacagctcacaatagagcaaatggctttatcaaagcaaacaactgagaggacatgacaatatgaggaagagggaagccacaggcttgtataacctaatttcagaagtgataccttttatttttgcttcacttttattagcta

SEQ ID NO: 41436 - DNA, 452 bp, Homo sapiens
gtttttgtgtgaccctgagttaaaaaatgatgaaaaaaaatttgtggacatttgttttctctcttattacataagtacctacataatatccttgattttgccttttggcccagaaagcctaaaatatttactatttggccctttacaggaagcatttgccaaactccagactagggtcttaggcgtaaatattaggtctagataggatcttgcacacagagtgactgactgcaggcaaatacataggtaagaagtttgagggaattttattgctataagcaaccactatcttccctgcaaaagcctgtaattgttccatccttccagcaatgcccctgatccccaacctgtatgagcagaaagtaggctatgcaagctggcagcctccaaggacagcacactctccaaggccttccccactcttccagcatgacacacacggtgccagatgg

SEQ ID NO: 41437 - DNA, 256 bp, Homo sapiens
ctgcctccacaagagggtgacatcactcacgccttgttaagtgggtccttctgttctctagtgtcaatccctggttgcttcctttcacaaagcttcttatccaacacactatcattgtcattagtcaactaattaaaatgcctattaacatggagaatcataaaaaagattaatacgtacaaccaacatttgactttaacctaaaaataaatgtaccttaatttgccagtttttccttgtgccaacaatccccgat

SEQ ID NO: 41438 - DNA, 346 bp, Homo sapiens
taggtttgtaaattccaagtgatgcttacttaaatttctttttgctttaatttgccagatgtatatacaaatgaaaacttttgagagaagagccttcagggaagagactgttttatgagctctcttaactatgacttaagtgaaataagggaagcagaatggttagcctccctttttcttctttcccctctttccttagttaagaaggcattacgattttcactgtgtagactgacatcttaaacagtggaacaggggagtgtctattgtagtgattctcaatttttggtgtgcccaaggccacctgggcaactttttaaagctctagggctgtatccctcagcaa

SEQ ID NO: 41439 - DNA, 385 bp, Homo sapiens
cagaaggggctccatggatacggaaagagctgcatgcaggaactcttcagtccaggccatgtggaaggcctaggacaagattggtacaaaccactgctcctctccagttcccgagaagggtcattaggcgtgctctaagtaagaatgagaacaccaccccaactgcatgtcccattccattcccccagcctcctcttctctcctttccctgaccatgatttaccctctatgcatactgtgtgcaaatgattgcccaacccagcttagcaaagtttagatgagaaaggtttgcctggttggaagaaaaactcttctgagtgtaaatacaatctgtaaaactactaagtgtgtacctagaagtgatagcgaaataggcaaggagact

SEQ ID NO: 41440 - DNA, 314 bp, Homo sapiens
ttatgggtatagaagcaagggagactcaaacgtagaagacgaataagaatctgtaaaataaagaacccagataacagaatgttaggttttagatatagctttagaatgagtggctctttgatgactcttgccacttggaactaaaagacccagaagagcttattttgggtgggcaggcagacttgacagagcaaagactgtgagcttgccatttaccgtcataattgcctttcattagctgacccactgattacactttttccacacaaaatcctttcccaaggcatctggctttagcaatgggaaaatgccat

SEQ ID NO: 41441 - DNA, 945 bp, Homo sapiens
ttaaagtgagacagtcacactagatgttccgtaagtactcacgctggagtagaaagagtattccatttccaaccaggagacctaggggccaagcgatatgaaatcccctgagactcagtttttccatctttcagatgggactgtgtgaggaacgagcagaacagtctgtatatggaagcactttgtaaagccttcagttctgtaggtaattgccactcttcttctctctagcagtctaaggtcctgtgctctctggtaggggtgcttcaatactttttttgtcttaaagtcacttccctccagcttctggtaatgttgtattgcttcttaattctagtcatttagaagttgataaataacaactgcttcttgttctaagcaaattacatgtcatttgatcagaactttatgaggaaggaggcttagaggggccacacagctactaggcaagccggctgtgtgctccttataccttgctgtattactgcgttgtcacaggagtttcctgaggacagggacaacgtcttactcatctttgcattcacgaaatctagtgctctgtttcacagtaggcatttaatatgtcttttatgtgaataacctgtccatatgttcaacttacattattctctccataatctaagcccctttcttctggttttgataccaagaagtaaaatatttggttggttagcctttttgtaatagtcctgtatagtattatgtttatttgatgatgtctgtatagtattatatctgcgtagtattatatattttgacagttcttttcatagaattttataagtagagttataagttaagaacagtcatacatccttaactcctgtactttacttctaaacgttgttaatggagataaatcttagaaccataagattttcccagatcctcccttctcccatccaaagagaaaaaggaaattaa

SEQ ID NO: 41442 - DNA, 827 bp, Homo sapiens
gttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 41443 - DNA, 3321 bp, Homo sapiens
ccgggcggggggttgcggcgctcaggagaggccccggctccgccccgggcctgcccagggggagagcggagctccgcagccgggtcgggtcggggcccctcccgggaggagcgtggagcgcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 41444 - DNA, 673 bp, Homo sapiens
  misc_feature (651)..(651): n is a, c, g, or t
gtatccgcttagcgagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaagatcaggctgatccgcttaagggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagcttagataaatggaagactctggnactgttgactggtgtgaaatgc

SEQ ID NO: 41445 - DNA, 271 bp, Homo sapiens
cccccctcctatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgcatgatagagggggggatcctcagagtcacct

SEQ ID NO: 41446 - DNA, 3637 bp, Homo sapiens
ccgggcggggggttgcggcgctcaggagaggccccggctccgccccgggcctgcccagggggagagcggagctccgcagccgggtcgggtcggggcccctcccgggaggagcgtggagcgcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataaaaaaaaaaaaaaaaacctgggggggggcccgggacccaaattgccctatagtggtcggattccattcactggccgcgttttaccacgttgggactgggaaaacctggcgtaccccaattaattgcttgggggaaatccct

SEQ ID NO: 41447 - DNA, 1358 bp, Homo sapiens
ccgggtattctaataatttatatttcttttttgtcccaggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 41448 - DNA, 2849 bp, Homo sapiens
ccgggcggggggttgcggcgctcaggagaggccccggctccgccccgggcctgcccagggggagagcggagctccgcagccgggtcgggtcggggcccctcccgggaggagcgtggagcgcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctga

SEQ ID NO: 41449 - DNA, 653 bp, Homo sapiens
gcctactactactaaataaacggccggtcgatgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 41450 - DNA, 884 bp, Homo sapiens
ccgggcggggggttgcggcgctcaggagaggccccggctccgccccgggcctgcccagggggagagcggagctccgcagccgggtcgggtcggggcccctcccgggaggagcgtggagcgcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagtaagtattaaaatgtaagag

SEQ ID NO: 41451 - DNA, 218 bp, Homo sapiens
tcaaaacaagagaagatggcgtgtagagataagagcatgcaagaccgcttgagactgggccactttactactgtccgacacggagcctcatttactgaacagtggacagatggttatgcttttcagaatcttatcaagtaagtgaattgttatgattaaatggagaattgaaaagttcgtttgcattttttaggttttctgtaattgtagtcattaat

SEQ ID NO: 41452 - DNA, 182 bp, Homo sapiens
gcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgtatgttctttattgacgtgaacgctgag

SEQ ID NO: 41453 - DNA, 561 bp, Homo sapiens
aatagcacaatctaaaaatctctaatctaccctccctcattgtatagcagggcagaaaaaaggaggaggagcaagaaaggtctagtgtagctacactgagaccagcacccaagtcctgtggctctatagctggtgctgttcattgtaattacactgcctctttgaactgtgtaactttatactcagtatttgccatgttgatgttgattgtcaaactaccaacagcagctataattatatgtataatgtgttagatattctgggaattttgcaagcgtggaagactgtagtccatgatctcagggtgttacatgttccctgtttccacagatttaaagatcatccaacgctaaatgacagatatttgttgttacatcttttgggtagaggaggtttcagtgaagtttacaaggtaagtataaggaactggatacaaagactgggggttaaattatcggctcctaccaacttggagaacattaagaatactgataattgtaggttgatatccattggttgaaattcaaaaactttaaaaacctgtatctttgggaaaacagc

SEQ ID NO: 41454 - DNA, 3225 bp, Homo sapiens
ccgggcggggggttgcggcgctcaggagaggccccggctccgccccgggcctgcccagggggagagcggagctccgcagccgggtcgggtcggggcccctcccgggaggagcgtggagcgcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 41455 - DNA, 3497 bp, Homo sapiens
ccgggcggggggttgcggcgctcaggagaggccccggctccgccccgggcctgcccagggggagagcggagctccgcagccgggtcgggtcggggcccctcccgggaggagcgtggagcgcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataa

SEQ ID NO: 41456 - DNA, 3964 bp, Homo sapiens
ccgggcggggggttgcggcgctcaggagaggccccggctccgccccgggcctgcccagggggagagcggagctccgcagccgggtcgggtcggggcccctcccgggaggagcgtggagcgcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagtttgctgggggaagcgcgccaggaaccagccctggcagaagtgttccaccagttgcacgatcctcaccgcaacattccttatccaatcccttaccgcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaagtcaaaacaagagaagatggcgtgtagagataagagcatgcaagaccgcttgagactgggccactttactactgtccgacacggagcctcatttactgaacagtggacagatggttatgcttttcagaatcttatcaagcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgttaacgttagcagaataccatgaacaagaagaaatcttcaaactcagattaggtcatcttaaaaaggaggaagcagagatccaggcagagctggagagactagaaagggttagaaatctacatatcagggaactaaaaaggatacataatgaagataattcacaatttaaagatcatccaacgctaaatgacagatatttgttgttacatcttttgggtagaggaggtttcagtgaagtttacaaggcatttgatctaacagagcaaagatacgtagctgtgaaaattcaccagttaaataaaaactggagagatgagaaaaaggagaattaccacaagcatgcatgtagggaataccggattcataaagagctggatcatcccagaatagttaagctgtatgattacttttcactggatactgactcgttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtaatattcttttagtaaatggtacagcgtgtggagagataaaaattacagattttggtctttcgaagatcatggatgatgatagctacaattcagtggatggcatggagctaacatcacaaggtgctggtacttattggtatttaccaccggagtgttttgtggttgggaaagaaccaccaaagatctcaaataaagttgatgtgtggtcggtgggtgtgatcttctatcagtgtctttatggaaggaagccttttggccataaccagtctcagcaagacatcctacaagagaatacgattcttaaagctactgaagtgcagttcccgccaaagccagtagtaacacctgaagcaaaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataagctttcttctgttagatcttttggcagcaaacaaccttccccccaaacctctgaattttgtgggtgtgtggtggtgtgtgtctgtgtgtgcatgtacacacacactttgtctagctcactttaaaagattcatcaaatggaattttaaaaataatctgaaaagaaatagatatttcaggccgggcctggtggttcatgcctgtaatcccagcactttgggaggccgaggtgggtggatcacgaggtcgggagttcgagatcagtctggtcaacatggtgaaacgccatctctactaaaaatataaaaattagcctggcgtggtggcgtgtgcctctagtcccagctacccgggaggctgaggcaggagaatttctggaacccaggaggcggaggttgcagtgagccgagatggcaccactgcaatccagcctaggcaacagaatgagactctgtctcagaaaaaaaa

SEQ ID NO: 41457 - DNA, 1133 bp, Homo sapiens
ggtgtctagaggatcccaacaaatgaagcacatggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 41458 - DNA, 970 bp, Homo sapiens
ggtcgcccacgcgtccgcggacgcgtgggcagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgca

SEQ ID NO: 41459 - DNA, 444 bp, Homo sapiens
actatatcttggggcactttattatacagccacagtaactggaaaacttaactgccagaacgtctcaaatgaagtgttgggactggtttggggcatgcagcgattcatgtgtgaccaacaacactaaagttacagggctgaagtttgagaattttaaaaaaatgatggtaaattcagagtcagctcttcccactcccttccattccagaatgcttctttgagcaggagagacaggggttgcagccagttcgtgcacccataattttgcctaatcccagcacttgcttggcagaagcggcccttcatctcgtgtgccctggtgggaaagtagtgagtactgacagtttagaccctcaccagcccacacctggatggtgttgccagctttcttcctcactccttgtctctatttttatttttatttatttttttaagactaaggtc

SEQ ID NO: 41460 - DNA, 470 bp, Homo sapiens
agaaaaaatattaaatgatcgtaaagaaactgtgtctgtagggccagagagatgatgtaagaatcaaaattctcccagctaaaggaaatataactacaatccataaagtctaaaacttgaatttaactgctggtctcaaatatttccttcctaactcaaagtttaagaaagtcaacagcaaaatgattattgttggctgggcacggtgactcacacctgtaaccccaacactttgggaggccaaggagggcagatcacttgaggtaaggagcttaaaaccagttctggccaacatggcaaaatcctgtctctactcaaaatgccgggcatggtggcacatgcctgtagtccctgctacttgggaggctaaggcacgagaattgcttgaacccgtggggagaaggctgcagtgagctaagattgtgccactgtacttcagcctgggcaacagagcaagactctgtttcaaa

SEQ ID NO: 41461 - DNA, 870 bp, Homo sapiens
atagacaaaacagtcttctattggaaaaagatgctatctgggactttcttttttaaatttaattatttttttaagagacagtggcatgatcatagcacagtgtaaccttatactctggctaaagcaatcctcctgcccccccgagtagctagaactgcagatgcacacccaccacacccggctaactttataaaaacaatttttgtagagaggggggtcttggtatgttgcccaggctggtcttgaattcctggttcaagtggtcctcccatcttggcctcctgagtagttgggattacaagtacgtagtagccactatggccagcctgccatctaggactttcatagctagaggggagtagtcaatgtctggcttcaaaggacaggctgacactcttgttaggggctaaggcagctggtgactttaagttgaagcccgtgctcatttaccattccaaaaaccctagggaccttaagaattatgcaaaatatactttgcctgtgctttataagtggaacaacaaagcttagatgacagcacatctgtttatggcatgatttattgaatattttgaggccactgttgagacctcttgctcacaaaaaaagatttcttttaaaatatcactgtccattgacaatgaacctagacacctgagagctctgatggaaatgtacaaggagattaatgttttcatacctgccaacacagcgtctgttctgcagcctgtggatcaagaagtcatttcaacttatgagtcttattatttaagaaatatatttagttatttagtaaagctatagctgacatactttcttgagatggaatctactcctggtgaagatgctgtgaacatttgaaatgacagg

SEQ ID NO: 41462 - DNA, 600 bp, Homo sapiens
ggcttttgattttcacaggacaaatgtagcccagccatctggagcccgtttttctccaaaccagggcttcctccttctctcttgcagatttcaactggggctcaccattttctgcctcttcctcctccagttttaaagagacaccatatccttctctgctgggaccaacttcccatgtactgctgccctgcacctgtgaaaacagctgctgtgttttctgtcataaaaatagctgccttttggcagagaagcacacaacggtactacgtttctgagccttaatgcagtgctcaattatttaggtgtgcttcacctgagatacacagagcatcttggaactcctactaagcagggcttctacaggcattgctcagctcagtacaaggttttcctttctctgcttttgtgattaccaggcagaaaccttaaaatgtatgaacttacaaagaaattaaattgtgccaaattagattcccagcccctagagataaccactaattaaagttccgctggagcgttttgcctgtattttgtatataaacgtggattttgtatttgtatgtaaataaaggtaggaccctgctgtccataaaaaaaaaa

SEQ ID NO: 41463 - DNA, 444 bp, Homo sapiens
gccctcattcttcaagtaagtcagggcagctcaacttttgtcaactttcgtatcagtgttttacttctgacttctcttgaaaaatagcttgctgttgttaaaagaagaaaaggtatgatgaatattccaacttattaaggtcccttcaagctcttgactgctgagagtccataaacatttcttgggcctgttcattagggccaactccctaagtccttgtcccaccctgagaaggggcaggggagaaacacccagcatctgtggtttcattgttaaatagatggtaggtaagtaagcaggagagtggattttgaactttttcagggtacagcactgcagatggaggaggactagattcagggaattcctgcgattggcatagaggttttcctccagatattagcctaagttatcaaagatgtagtcacagacaacagccctgaa

SEQ ID NO: 41464 - DNA, 391 bp, Homo sapiens
ccttacttggcctagaattgtctttattgaactaaaattagtttaacaccatgtgccaaatttgaaggattttaaaagatctaggatgcctgtattatgaaacggtattgaccttactgtttactaagttgcaccattttatttttatgagaatttatcgaaggttattttcagtgactctgtaataggagttgttgtatctcttcctcatccaaaatggtttttgtattataaacaatcagaatcatgtccctaattttctcccattttccttgagcaaccagaaaccccagagtgaaattagtgacagacgtgtctggtatgtataccactctctctaacatgagctacataataccaaaaatcattattatcatttttattatcacta

SEQ ID NO: 41465 - DNA, 359 bp, Homo sapiens
attgccttctttctgattccctattctatccactctactacagaatctttaaaagaatttatcatactgggcatgatggctcatgcctataattgcagtgctttgggaggctgagtcaggaggatcacttgatgccaaagagttcaagaacagcgtgggcaacatggcaagacctcgtttctaccaaaaaaaaaaaaagttttttaaattaaaaaattagttgggcatggtggcatgtgcttgtagtcccagatactcaggaagttgaggcaggaggactgcttgagcccaagagttagcatgagctatgattgcgccattatactccagcctggaaaacagagggaaaccctgtctct

SEQ ID NO: 41466 - DNA, 312 bp, Homo sapiens
gtgggccaccaacattttctgccttttcatttgtttcttcccttccacatatgggatcaacagccaggcttatagtataccagaagtatcccaaaatgctgtctccacattgcaggggcttttctccatacactggaaattttccacagacttgcagggagccatggatgcctccaggacttaggaacatcctttcattgttggcccccaaagcctcagttagcaggagggaagtttaaagctgggtaggaagactgggaaggtctggagtgagtggcttagaaaagctctacagcaaggattaagaaaagc

SEQ ID NO: 41467 - DNA, 422 bp, Homo sapiens
gacttctccccagtcctgtggtctcagacagacatgtacataatcatgaatagttttacaacttaaagcgcaggtaagatggcaccagatggactggggacactcccaaactcacatttgatgggggaagggttaatacctgccccccttaatagactcctttatccccaccaaaaagacagcagaaatctctttaatacacttttggtggcagtgcagggaaagcctgtgttctaggtcaaagaaggaatggtcaggtgtcactatgcagagaatttgagagctggacaggcccatggagcacatcaaatgcaatacccccatttcacagataaggaaactgaggcacagggaatacagctagttactggaagagcccaagccagtgtcagaaccagtacttgtgggctgggcacaacagc

SEQ ID NO: 41468 - DNA, 365 bp, Homo sapiens
ctgtaccacattttatttacaaaaaaaaaaaatgtttttaaagaagcaatactagctcctggataaaggttgggttgagcagttacacagactacaatgctgccttcactaatctttagctgtgaaaaaggaagagaaaaacatgccattttgtttgctgatttgcacttgaaccccagcaaaatgtcatggtcctaaccctctggtgtaacctgtctggagcaatagcatggtttatttttagaatctgagtgacattttctgtttggtaatctgtctaatttcagatggagctatagatatggatatagataaaatttggcattttcaaacttgtactttcaaagaccttagaaccaaatgtc

SEQ ID NO: 41469 - DNA, 473 bp, Homo sapiens
aacaaacaaacaaaaaaacatgtccctcaagtgccttcgcttttcagcaccatgcccagtccataccacaatgtgcatttgggtgactgtggggtcaccctcaccccaccacacacacatgaccctgagcaccattaggacagtaatctgggctgttttgctccctgtggtatccctagtagccatacacaggaggagctgaatcaaagcatgctggatgagccatagctgaggaaagaaggccgggcacctgccctgattatgggcagggggccacataccctggtttgcttggggaggccatgttcacttgtctttcccacataataataatggtgccctgttcactctcaaatgtcccaatttggtgacatatgatcaatgtagttattggaaaggagaaggggttagccccgagcttctgctctttcccagccccacactggtttcccacttgcccccaacaagcacaa

SEQ ID NO: 41470 - DNA, 638 bp, Homo sapiens
ccttgtttgcgaagattcctgggaacccttaaggggaagactcaagaaaaataaagatacccagggtaattccaaaccagacttgaaagcagaaactgaaagcagagaaaaccactacatttaagatggtggcttaacgatagcagtggaaaagaaacagcatgcattgggcatagatatcacattcttccaagaacttcgttggaggacagtttctccgtgggactctcactttctgaacatcttgcaattagagacgctgacttcttttgttctgaaatatattttcaaggattctgcatggaaagtagccctgaaatacacagaatgtaccttctttgaggcactgacttcttttgctttgaaatatctttttcaaggattctgcatagaaagtagccttgaaagatacagaatttacctccagcaacagggtaggcatgcttactgtgcattgtaatggatttcagttccctggtttcagagttcttctcttgtcatgtggctcatgtgcaggtgtcacctggccttcttcacatcaccctgtggaaaatggggctcaaggaactgccacaaaaaattgatactctgcctattgctgtcaatctgagtaataaaattctttgtttccaacccag

SEQ ID NO: 41471 - DNA, 666 bp, Homo sapiens
gctggtcacacacattttaaccacccatctttgctacaagggaaaaaggccaaaccttgtgtgggtgaagaggcagactcaaatgctcccgatgcagaggaacgaggcggctaccactcaatcaccaattaccatttgcatgctacccaacctggacctttccagggcatactggaccactccccacttccttggggtgcaatgaattgcagacagtttaatccatgggcttttgctgattctgttttctctgcttggaatgcccttctacacagaggaagtctttcaagacccaggtcaaaggttagctctcctgtgaacacttgttccttttctatctggtataagcagccattttaactatcgttaaaggtcagggtttcttaacttgggtctgcgggtcattatgaataagttttagagggacatgtctgtatctatgtccacatatgttactctggaggccagggtcagagattccagattctcagattcggtgacctcaaaaaaaggtctcttttggccaggcacagtggctcatgcctgtaatcccagcactttgggagggtgaggcaggaggatggcttgagctcacaagttcaagaccagtctgggcaacatagcaaggtatcgtctctaaaaaaataataaaaaattttaaaaagc

SEQ ID NO: 41472 - DNA, 527 bp, Homo sapiens
gaacaacttacatcctttttaattttctctctttgcttaagatttggagatgctaagatacataggcatggaagataaagttaatggttgaaaactgaaacaatcttttcctggaaatttgagctgtagtggataggcaaactattatgtgacaatgtccacaaaacatatgcttttatattagttcagctgttccttctagatacataaatggaaaatagttaatatttgaaaattataatccttatctaaaagtcgaactatacagatagacaaattatatgttttaggaacaattgaactgcttcttcttggtaagcaactactcttgagttcaggtggagtattccttcaggaatcatcttggttatactgtattaaagatgctagctttaagatgagatgtggataactttattccttccattatccccactctctcctggagcttccatcaatgaccttcactaactctccagggatatcttcacttctgttttcaaacatgacagctctcttctatctgg

SEQ ID NO: 41473 - DNA, 2619 bp, Homo sapiens
atgcttggaaacacttgccatactcaaaaaacattgcttatttcctttttcgtcagccggctggaggagcatcggtccgggaggtctctgggctgaggcggcgacagctcctctagttccaccatgtccgcgggcggagacttcgggaatccgctgaggaaattcaagctggtgttcttggaggatggaacaatcgggcttcggctgtgggatacggcgggtcaggaacgtctccgtagcctcattcccaggtacatccgtgattctgctgcagctgtagtagtttacgatatcacaaatgttaactcattccagcaaactacaaagtggattgatgatgtcagaacagaaagaggaagtgatgttatcatcacgctagtaggaaatagaacagatcttgctgacaagaggcaagtgtcagttgaggagggagagaggaaagccaaagggctgaatgttacgtttattgaaactagggcaaaaactggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggaggtgatctattagcttcacaagcacaaaaaaagtcagcgtcttcattatttatattttacaaaaagccaaattatttcagcatattccggtgataactttaaaaattagatacattttcttaacatttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagatggcaaagcagcagtccgaccaagcccactggaattatcctttaattttacagataccacttgctgtaggctgtggaccaagatgtccagaattattcttgagcactgatgtaaattacttagatcttctttgaggtcagaattcagcgatcacggtaggcagtgcttgaatgagaaaagcctcctggtgcatcttcaaaatgagtcctaaagaacatactgagtacttataagtagcagaacataaaatgtatttctgactaacacaaatggtcctttcacatgtgctttattagactctgggagagaaaagtaaccaagtgcttcagaacaggtttttagtatttacttcttcatggtaagataatgaagttctaatgaactatttctcccaaggttttaaaattgtcaagagttattctgtttgtttaaaaagtaagaaacctctgtaagcaatagattttgcttgggttttctttcttaaaaaaataatactatgcaggcaagacaccataaaagtttaattccttacagaagaaccagtggaagaatttaaatttggcactacgatcaaaactactgaattagcagaaataacgatatctaaagcttaccagcaaaagaaccctcagcagaatagcaaaaactttgctcaggacatttgaggtcaaattgaagacggaagacggaaaccggaaaccgttttcttgtaagcccctagaggcagatcaggtaaagcatacatagtagagggaaaggagagaatggaaataaaactgaatattatgcagatttatgccttattttttagcattttttaaggttgggtctttcaggctggttttggtttgtattagatctgtatagtttagtgatttagttttatatttaagctacgattaatattttttctttggcgatatttctttgctttttttttttaacaactttccatttttagatgtttcgttgaatctatttagagcttcaccatggcaatatgtatttcccttaaaacactgcaaacaaatatactaggagtgtgcccttttaatctttactagttattgtgagactgctgtgtaagctaataaacacatttgtaaaaacattgtttgcaggaagaaaacttcgagttacaggtcaggaaaagcctgctgaatttatgttgtaaacgttacttaacacagtataaagatgaaaagacaacaaaagtatcttcatacttcctcatcccctcattgcaacaaaaccttaaactgggagaaccttagtcccctctctttcctcttcctcctccacttcccacttattgccactttgtaatattcagagagcacttggattatggatctgaatagagaaatgcttacagataatcattagcccacataccagtaacttatacttaaagatgggatggagttataaagtgcttttataatccaatataattgctaaaggcaagggttgactctttgttttattttgacatggcatgtcctgaaataaatattggttcactatg

SEQ ID NO: 41474 - DNA, 3065 bp, Homo sapiens
ggggcactcagcaggttgggctgcggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcccgccgacaccgccctccttcccttcccagccgcgggcctcgctccgtgctcggctactctgccgggaggcggcggcggctgccagtctgtggcgagccctgctgccctccagccgggcttctccagccgggctcctccaccggcccttgcaggggcacagagagctcggcgcccgcccttccgctcgcctttttcgtcagccggctggaggagcatcggtccgggaggtctctgggctgaggcggcgacagctcctctagttccaccatgtccgcgggcggagacttcgggaatccgctgaggaaattcaagctggtgttcctgggggagcaaagcgttgcaaagacatctttgatcaccagattcaggtatgacagttttgacaacacctatcaggcaataattggcattgactttttatcaaaaactatgtacttggaggatggaacaatcgggcttcggctgtgggatacggcgggtcaggaacgtctccgtagcctcattcccaggtacatccgtgattctgctgcagctgtagtagtttacgatatcacaaatgttaactcattccagcaaactacaaagtggattgatgatgtcagaacagaaagaggaagtgatgttatcatcacgctagtaggaaatagaacagatcttgctgacaagaggcaagtgtcagttgaggagggagagaggaaagccaaagggctgaatgttacgtttattgaaactagggcaaaaactggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggaggtgatctattagcttcacaagcacaaaaaaagtcagcgtcttcattatttatattttacaaaaagccaaattatttcagcatattccggtgataactttaaaaattagatacattttcttaacatttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagatggcaaagcagcagtccgaccaagcccactggaattatcctttaattttacagataccacttgctgtaggctgtggaccaagatgtccagaattattcttgagcactgatgtaaattacttagatcttctttgaggtcagaattcagcgatcacggtaggcagtgcttgaatgagaaaagcctcctggtgcatcttcaaaatgagtcctaaagaacatactgagtacttataagtagcagaacataaaatgtatttctgactaacacaaatggtcctttcacatgtgctttattagactctgggagagaaaagtaaccaagtgcttcagaacaggtttttagtatttacttcttcatggtaagataatgaagttctaatgaactatttctcccaaggttttaaaattgtcaagagttattctgtttgtttaaaaagtaagaaacctctgtaagcaatagattttgcttgggttttctttcttaaaaaaataatactatgcaggcaagacaccataaaagtttaattccttacagaagaaccagtggaagaatttaaatttggcactacgatcaaaactactgaattagcagaaataacgatatctaaagcttaccagcaaaagaaccctcagcagaatagcaaaaactttgctcaggacatttgaggtcaaattgaagacggaagacggaaaccggaaaccgttttcttgtaagcccctagaggcagatcaggtaaagcatacatagtagagggaaaggagagaatggaaataaaactgaatattatgcagatttatgccttattttttagcattttttaaggttgggtctttcaggctggttttggtttgtattagatctgtatagtttagtgatttagttttatatttaagctacgattaatattttttctttggcgatatttctttgctttttttttttaacaactttccatttttagatgtttcgttgaatctatttagagcttcaccatggcaatatgtatttcccttaaaacactgcaaacaaatatactaggagtgtgcccttttaatctttactagttattgtgagactgctgtgtaagctaataaacacatttgtaaaaacattgtttgcaggaagaaaacttcgagttacaggtcaggaaaagcctgctgaatttatgttgtaaacgttacttaacacagtataaagatgaaaagacaacaaaagtatcttcatacttcctcatcccctcattgcaacaaaaccttaaactgggagaaccttagtcccctctctttcctcttcctcctccacttcccacttattgccactttgtaatattcagagagcacttggattatggatctgaatagagaaatgcttacagataatcattagcccacataccagtaacttatacttaaagatgggatggagttataaagtgcttttataatccaatataattgctaaaggcaagggttgactctttgttttattttgacatggcatgtcctgaaataaatattggttcactatg

SEQ ID NO: 41475 - DNA, 915 bp, Homo sapiens
gaacaaatgttgcaaacgaaaatcaccctgccaaagcaaatcatacagtttcacaaaagtagtaaatttggcactcgttcacaactgacagtgcagattattcagacaatgtgttctgtttttattgtttatgttaaattgttatcattatgtttcccataattacctagattgaacattagtacaacctacatttcaacggacttaagagtcttttatcatcttaaaatgaaagtgataaattaaaatttacccctaaagtgctactgctatttaacaccattagtctgtactgctctgtgttctagggcccctggatatttattcaggaatgtgaatcagcttcagtcctcttattgcgcccaaactctccaggagacaggcaggagggggatgatggtactgagagagtatgtgtcccagagcttgtcaggacacagtggcagaattgctctcatcctcttctacttctctgtcctgcagattcctgcaggtttatgttgattggcatggcataaggatattaccatcagacattctctgaagaatatcagaaagcagatatttagtagatacggtattttatctagtatgaattgtgcagtttgaagatgtctgttaatgactagccctatcagattttttgagccatttcccagcatttctatgcttaatgtaaatatttgttgcatggacttggatgctttaatttaagaggatttcagatgtcagcctccagttattatgatatttttagtttacatcttttttggggggtggggtggctgggtatatttgaaaagagacagctggataaaggctgtatagccaagttaatgtatacagaacttcttcggtgaagatttgattgtgattgagtctctaaacacatatacaattgtttctttggtaaaa

SEQ ID NO: 41476 - DNA, 496 bp, Homo sapiens
tatgtattacttatataattaaatgcaaattaattacattagtgaaagcaagtaaattataggtattgagaaatgaaggctgaggattgaatttataacaattttgaaatatatgaaaacattacagaatatagctacaggtaggataagaaggaatgaatattcacaatagctaaaagatggaaataacccaaatgttcattggtagaggaatggataaacaaaatatacaatagaatattactcagctttaaaaagcaaattgtgacacatgctacactgtggatgaaccttatagacattacaataagtaaaaaaagctaatcatgtggggtggggggaggggggagggatagcattggtagatatacctaatgctagatgacaagttagtaggtgcagcgcaccagcatggcacatgtatacatatgtaactaacctgcacattgtgcacatgtaccctaaaacttaaagtataataatgattaaaaaaaaa

SEQ ID NO: 41477 - DNA, 261 bp, Homo sapiens
taattaacaaggaagaactgcaaagccccaaatacaaccaaaaacaaaccatgtgctattttaaagcagagaagttacgtatgtatttctggatgaataaatctgggttctgggctctataggcaagcactacaaggtctatagaagattactgaggttgctcattgatatcccttttccttcgtaagttttgcacctgctaagtggaccaggtgagcagccttcatacagatggcctctttgcccactctgggctatcta

SEQ ID NO: 41478 - DNA, 783 bp, Homo sapiens
gttatttgtgacatagtgggtactccataaatattagtaattattagaaattgactaagatttacattgagtaagattattacattgaataagattttttttttaatcctgagcttcagttttcgcatctctaaataagaatctattcaatcaacagatacttatctggctcctggagctatacagcaaaagacctgtggctatagcagagcgtagaattcagggagttaataacacctacctgcagaatgtatgtgaaaatttaatgagacaatgtatagttgaagtacttgcttgttacacttcctgggcatactttattcactaaataaatgttaatttctttcctttctcctttttagttggtggaaaaaatcttaccctctttcttataaagtttaaatatacacttcaggaggctggcgtgggcagatcacttgaggttaggagtttgagaccagcccgggctaacacggggaaacctcgtctctccctaaaaatataaaaattagtcaggtgtggtgcaggcacttgtaatcccagctattcaggaggctgaggcaggagaatctcttgaacctgagaggtggaggttgcagtgagctgagatcgcaccactgccctccagcctgggcaactttcaataatataatagcttggctaatgggaaaatcatttgttttcttatcactttaatataaatggtatgtgttgatggtatgtgatttattacagcaatcacatacataatgccaaattattttgaattagattggtgttaca

SEQ ID NO: 41479 - DNA, 610 bp, Homo sapiens
aggctggcccaagaatagcctggacaatcacctgctggggacaccgggctgcccctcctccgcccacagcctcaggccacctgtctcatccgtgaccgagaaacggagctgcagtgggaggcgggacatgctgggatctacccatggccaggccaagctgcgccaatcactcaagcttcactttgatcacttgctctaccaaataaaacagaacaaaataacaccatgtcctcctttccacacactcccaagcctcccatcccacttcccggtgctgaccccatgagaacactttgtgcgtctttctaggtattttctatcctcctcaagcacagaaccgcacgcagagtgatttttttttttttaaacagaaatggcaccagggcagatgatgattttttgtaccatttcttgactttcttgggcattttccacaccaggacagatggaccctgctctccttcctccccgcccacagctacctcgcagcagccacacactgagccataaaccctagaacgaaactgcgtatctcaagatacacaacgtcctcactgacaaaacacaacctcctcactgttaaaacacaacatcttcagctgaaaaacac

SEQ ID NO: 41480 - DNA, 239 bp, Homo sapiens
gccttgcttgcctctgtccctctgctgtgcccctgagcattgtcagtgttggaggctggaaactgtcccatggccctctgtggttcagagtggccatgacccatcctggccttgacccatgggtttctcctggcatttacaggacctgaggatgggggcgtgaaggcatccccagtgcccagtgaccctgagaagccaggcaccccaggtgaagggatgcttagctctgacttagacag

SEQ ID NO: 41481 - DNA, 891 bp, Homo sapiens
ggagggccccgtcagccctgatgtggagcctggcaaagaggagaccgaggaaagcaaaaaacgcaagcgtaaaccatatcggcctggcattggtggtttcatggtgcgacagcggaaatcccacacacgcacgaaaaaggggcctgctgcacaggcggaggtgttgagtggggatgggcagcccgacgaggtgatacctgctgacctgcctgcagagggcgccgtggagcagagcttagctgaaggggatgagaagaagaagcaacagcggcgagggcgcaagaagagcaaactggaggacatgttccctgcttacttgcaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggagatgatggtccagatattgcagatgaagaatcccgtggcctcgagggcaaagccgatacaccaggacctgaggatgggggcgtgaaggcatccccagtgcccagtgaccctgagaagccaggcaccccaggtgaagggatgcttagctctgacttagacaggatttccacagaagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtggactccctttgggcaatctgccctccagcagcccaatggactcctacccaggcctctgccagtccccgttcctggattctagggagcgcgggggcttctttag

SEQ ID NO: 41482 - DNA, 757 bp, Homo sapiens
ttataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaa

SEQ ID NO: 41483 - DNA, 319 bp, Homo sapiens
ttttgttctatcaacatgataaattatcttcttcctttagcaaaaggctgtaagaaacagtatctcttcctccagaacacatattcaaatcccggaggagaaaaaacatcctgagaatataagacagctataaaaagctcctgaagccagccctttctttcagctcccagtcttctcttgaattaccaatttttggggctaggcataatagttcacacctgtaatcccagcactttgggaggctgaggcgggcagatggcttgagcacaggagttcgagacctacctaggcaacatggcgaaaccccgtctctaccaaa

SEQ ID NO: 41484 - DNA, 401 bp, Homo sapiens
atagagattggagtttacttaaagaatcaaaggaagctgtgtgggaaggtatctttgtttaacatctgtctgccatttaccaccatttgtaccccacagggagaaaggagaggctgcctcagagctaaatttaagttgcaagggtataagcagcacttttaaaggaagacagataacagcttcctgtctgggaaagattactgaaaaggaaactttgattcaacatttccttactcttttggtgagaatgattcctactccctacataaagtccagggaggagctatttgtagctagttaagtaagatgttttaagtcctcataagtcttttcttcaaagtaaatatttattctcttcaaaagccaactagtgtttaaaatcttcgcttcttttattttct

SEQ ID NO: 41485 - DNA, 381 bp, Homo sapiens
tgagatggagtgtcactccattgcccaggctagaatgcaatggcgcgttattggctcactgcaaactccacctcctaggttcaagtgattctcttgtcgcagtctcctgagtagctgggatcacaggcacacgtcaccatgcccggctacttttttgtatttttagcagagatgaagttttaccaggttggtcaggctggtctcaaactcctgacctcaagtgatccacccgcctcggcctcccaaagtgctgagattacaggcatgagccaccataccaggcccacaaacaccaatttttaaaaactttggttttagcagaaagatcttaggggaaccaggattccatctgaaagtagacttcagcccacttctctcagt

SEQ ID NO: 41486 - DNA, 481 bp, Homo sapiens
aaaatgctacagtgaagtaaatctctttttcttacctttgtgtacatagacagttttccaataaatcaaattatctggtaaaataatatgtatattcttaagactttagatagaatttgaaagtcttgaatggagctttgaaattgaaatgtcttgcctgatttggttggtcagatgagtaggaggaaatcagttcttttagccgtgtttggttaaaggttatgttttataaagtgtgttttcaaaattttcagaagtgcttaggtactccttgacacagtttcatgactttaaaaaacttgccttgtgcttccgtttaatttgaaaaacaaatttcacatcagcaaagtatagcagtctattaaaatagaagctaattctgcaaaatcgtttataccattgtttttcttaaatttgaatatatatactgtgcaaaatagaatgaccaccaaaaagtgtacttttttgttaaaagtggaat

SEQ ID NO: 41487 - DNA, 414 bp, Homo sapiens
gcggcgtgtggaggctgccgttaccttctcatgtttttaatgtaacagccagcagcatgtttacgaaactcatgctccttcaagtatacacatgaaacacaagccatgggacgtgtggcgctgttcgcagaggtcggggctgggtggggggctgggacacggagaccccaaccgcgtgctcaggccccagcgttactcgggcccctgatgaccctaaatgactggggtgatgcaggcatccctgccgagggcggcacttggtatctggggagagggttggcgggagtcgcatctataaagtttcatttttataatcatatgacttagtttaacaagcaggagaaaaatccattgtattacttcttttgttaaaataattaattatagctcagcacctaacttagccaaattgat

SEQ ID NO: 41488 - DNA, 753 bp, Homo sapiens
taaaagaaacctcaaaatctaacatggttcagttaatggaatgtctacatgatgtgacacagtctacaagtctctctacacatttctggaatccacagggctctggaaacagagaggtgttcatcagctcatatggtggcacagtatccctttaagtgaagtgcagctattatggtcattatttatcccagttagtagaaatattcatgtgtttgttacaggaggttgctgtgtttgattaaaatactgttcccaggcctcatcagggataagtaccatcaatatatgtttaagttttttactaaatcatttttaaatcgtggttatatatatatatatataacgtaaaatttgccatttgaactattttaagtatacagttcaatagcatcaaatacactcaaataactatgcagttttcacggccgttcattcattttgtgaaactgaaactctgtattcattaaacaacaactcctcatgcttcctccccttaatccctgacaatcactatctgtgtcgtgtctctgtggatttgactaagtacctcatgtgagtggaatcatacgctatttgtccttttgtgactggtttatttcacttagcataatgtccttgatgtttatccatgttgtagcatgtgtcagaatctccttacttaaatttttattttttcttacttcaacattcaagggaatctccttactttttgaggccaaatagattccattgtatgtatgaaccacactttgt

SEQ ID NO: 41489 - DNA, 699 bp, Homo sapiens
taaaagaaacctcaaaatctaacatggttcagttaatggaatgtctacatgatgtgacacagtctacaagtctctctacacatttctggaatccacagggctctggaaacagagaggtgttcatcagctcatatggtggcacagtatccctttaagtgaagtgcagctattatggtcattatttatcccagttagtagaaatattcatgtgtttgttacaggaggttgctgtgtttgattaaaatactgttcccaggcctcatcagggataagtaccatcaatatatgtttaagttttttactaaatcatttttaaatcgtggttatatatatatatatataacgttcaaataactatgcagttttcacggccgttcattcattttgtgaaactgaaactctgtattcattaaacaacaactcctcatgcttcctccccttaatccctgacaatcactatctgtgtcgtgtctctgtggatttgactaagtacctcatgtgagtggaatcatacgctatttgtccttttgtgactggtttatttcacttagcataatgtccttgatgtttatccatgttgtagcatgtgtcagaatctccttacttaaatttttattttttcttacttcaacattcaagggaatctccttactttttgaggccaaatagattccattgtatgtatgaaccacactttgt

SEQ ID NO: 41490 - DNA, 1385 bp, Homo sapiens
ccttctttccagagcatcctccgctctcagcagagctgcttctgcccacccatccctctactatagcactgagcactgtttgcccgtgtcagaatccctcacccacatgtttagcttggtatccgagtttgggaggccggcaatgactttcaacatgaattgctccatctacccatccatgcatttggcctacttatcttgaccccgtgcttttggccttttcttctcctgaaagcaaaccctttcattttgggtgggctgtgtagcgccatgggctgtggttatgaagcaaacaccctttcttgtagctgcctcctccggggttactgccctgagcacgtcccagctggatctcgtctgccactgtcacccatagcttcttccccatggtgctttccatgtgtcacacaccacgactgtgacccagggtcggggtcaagagtagcctggggccaagccctcccacccatgagcggagaagtcctccccaggcctcaccttgcctggcgcatggtccctcccatgagctttgctttcagcctttcagcttcctccacagggtggcagtggttgtaactcatccattcatcccttcatcccttcattcattcactcacagccaacagacgtttttaaaaaattagccagtgctatactagagctggctcccaaggacccgctgccgcattgccttttgaaacaaaacaatgaacacgttggtaaaggggccgtgcttgtgtgtcggtgacaaggcgagatccctgagtcaggtcaggcttgtagattcgagttctgttgcgagtttgattgcccctctgactttgtcccctgtacaactaggttgattaggaatcagccaactgtgttccctgggtgctcagaaatcacagcccatatcctcgagaggccaaaatgagagccagggggttccaagatgagtggctgcttctggccgggagcaggttttcaagtcattagaacactctggcctttcctggaggtgatcttggagccattcctgcccctttcaagaggagttaatgcccagctctgtttagagaaaattgggggagatgattgctcatgtgggtgataagaatcacctcccgtgcaggggtctgcatagaacactccataggcaaacctgggtgtccaaggcacgtggcattttgcaaactctgggtgcagctccgagctgtcctgcaggtcccagaccaggtgagaactccctgagttcctgctgcctgggtcgggggtgaggcataggtcttgggggttcaacctggaattctgaatgtcattcattgcattggagaggaaggagagtaggcaaagccaagaccctggaactggtttcaagaagcaggaactggggggatcctcta

SEQ ID NO: 41491 - DNA, 675 bp, Homo sapiens
aaaaataacagattagtttccaaggctggttgctgcagattgtgggacagagttctgtttttgcatattgattttctcctcagggaaacacattttaggaaaatctagtgtagggcggaagtcaatgtaccatgagcaggaccagcttctcctgccactttctagttgtgtgatttgtgccaagttgctagacttctttcaccctcagtttcctcatctgtaaaattgagatactgcataagagtttgatgaggattaaataaaccaatatacataaagtccttagcatagtgcctagaacatggaaagtagcaaattaatgtcatctgctgttaatgtaatcttactaatatctttttttacctgacttaatccaggaacttaaccagagaaaggggataaaattccaagggatagcatttcagggaaaatccactggagaggtttcataggccatgaagcatatattgagtgctctgtgtgataataaaaagactaattgggaaaagtctgtatatacctcaccccaagagaaggataccatcagagagttgcctttaaatatttaatatcttatgtttgattgataaataatatgcctgagaataaatttactccagagacagttacatggcagcattgtaaaaaaaaaaaaaaaaaaaaagtatagtagag

SEQ ID NO: 41492 - DNA, 649 bp, Homo sapiens
cagtgcctgtgccagcacctggagctgcctgccccaccacagcagccagcgtgcctggctgtgcacagaggccagacctgtgctcactcactcacacgcccctcaccactctgtgcctggctcacccttggcaggcatgggatctcggccagtagcacgagccaagcacagcctgctgggccaagtgggtaaaacgagcccagtgggtgcgagcaagactcaagcagaggcaccaccagccgccgaggcaccaccagccacagaggtttctggctggtgaagcaacacctgaagaatcctatggcattttcctgactttgaaatttacccacttagtcaagaaaatatgaagctattcattccctttacttgtctagcagaatatttccacatagaagattttagtctttgtcatcaagactgcgtaacatttaacactccaccacatcaaaatgctacttacacatacataataaacactcagagaggaatgctgcctcagacatcatcttttcttcactctgtctaaagcatgaatgtccttagatgttcattcaaaattagtgccagggagtgctatttggcaaggccacttagaatatagtaattaattagaatgcatttattaaattaagctgaaactatcctc

SEQ ID NO: 41493 - DNA, 476 bp, Homo sapiens
aacacccaactccagtaagctctagacttccacgtgggagaaggaagctactcaactccagcccattccagccactttgtcccactggggtagggagtgggtactgaagagaagcataggggacattcacagccaagggactcaggctcactaaaacactcaggctcactaaaaaccctcatacttacagcacactgatttctgacaaaggtgccaagacaattcagtgggggaaaagcagtctttctttcaacaagtgattactgagacaacttgataaccgcacacacacaagaatgaagtgggagctctacctcacaccatatgcaataattaaattaactgaaaatgaatcacaggcttaaacgtaagaactaagaacgataaaactctgagaagaaaatgtaacagtaaatcttcaagatcttgggtcaggcaaagtgttactagatataataccaagaacacacaacaaa

SEQ ID NO: 41494 - DNA, 614 bp, Homo sapiens
ccactcacgatacctcaaactccttggctcaagtgctcctccctgcctccgccttcagaggagccagactagaggcatttgccaccaggctggaaaaatttttttttttctagagacagggtctctctgtatttcccagggtggtcttgaattcctaggcccaagcaatccttctgtcttagtatcccaaagtgttgggattacaggcacgagccaccatacctggacagaaatacaaattaaaaccacagtgagacagcattttattcccattagaatggctaaagtttaaaaagatggacagttccaagaattggtgagaatgtagagcagtagttcaggcctgttgcttgtaggagtgtgacatggtacagccactttggaaagtttgtcagtttcttacaaggttagatatatacttattcaatttagcaatactactcttaggtgtttgttacccaagagaaatgaaaacatacagtcaacaaaaaaccatgtgaatgttcatagcagctttattcacaatagctggaaaaattggaaacaacccaaatgccatcaacaggtgaatggataaacaagttggataaataaacaatggattactacttaga

SEQ ID NO: 41495 - DNA, 385 bp, Homo sapiens
attcacaaaaattaaagataaaaagatttatgggtgaaaaaattgtctattttttcaggccgcatttgtcaaaaggaagctgaatagttggcttttaatatgtaatattaaatagggtttatcaactgttgtgttcccatggtctttagaatatgaatatgtagaaaacaaaagttgaaaacttaaatttagttcattatttaatttttttctagaatggtgattttcctagtttgttaactatgttttagccaattttgattttaactattaaaatctttcctttaatggttttaatatggtgttgatttttggttatacaattttacacaaccagagagtcactttctttaagagatcctaatgtacatggaaaaatagaaag

SEQ ID NO: 41496 - DNA, 455 bp, Homo sapiens
tacagtacttaactggcaaactccgagtttataaatgacgggaaacgcgccctttcagaaatgcctcaaacagtagggaagaaggaattggcagcctagtgaagcagagcaagagctggaattggcatagtgcgtgtcgccttagctggatggtcttggcagcatacagttggattggcagaagtaatcccaagggctgctggcttcagttttgatagcctctttggagtcttctcagaagtctccaaaatgatagtgtaatcttaaaatggctagctttctgcttatgaaagaggcaagagagattagcacttttttaggcttaaggtactctttaagaaacaaagggccaggcgcggtggtttatgcctgtaatcccagcactttgggaggccaaggtaagaggattgcttgagatcaggctgggcaacatagggagaactctgtctctacaa

SEQ ID NO: 41497 - DNA, 255 bp, Homo sapiens
gtgggaggtggaagtaggattgaaatccagccctgcctgtgcctgaagccaccgtactggttgtaaccaccaccctgacagatcccactgcagggacttaaccatcaggtgatatcagggaccagggtgtcagtactcctggctttgcggccgtgctatctctgctggaacccttaaccccgctgctgccatgcagtcagccagagactgtccataaaccaatgggcatggttgcgtttcaataaaactttattt

SEQ ID NO: 41498 - DNA, 361 bp, Homo sapiens
aaggaaacctgatgttttagttagcctatgtaaccccatcacaggttgatgtacagtttccattaggttctggaggaaatactgaaagcagtgtgtgtacctgcccactgccttcacacacccaggcctggggttttaattacttcaagcaggccagcctcaggtgcccacagccctgagaaccagtctgtgcccagtttctttctcttctctcagattatgaactccccaaaggcaccatccaggtttttaccccgcttgtcaaattcccctctggcccagggctggctgctcagcaggagtgtttaataagcacttaattgcccggtgagtacagaccattccagctcaccttaactgt

SEQ ID NO: 41499 - DNA, 464 bp, Homo sapiens
cttgctgtaacccctattcctgcccaaattaagcctgagctctccaagtgcctttggacaaacgcattggcctccaattgctggccccagaacttggtaagtttccccagacccttgtcccttcctggttctggattcctcagccacagaatgttataagaacttccagaataacgtacagactaaacactgcttaccaaaattaccgtacatcaggaatattcagccaaaaacaactgtaacatttccaagtcattccacatctaaatagaaataaaatcttgtagagatattgcccaaaagcctcagttcattgtagctattaacaagaagaggaaaaaaatggctcttgaataaaagaatcactagagtacttaagtgagttttgagaacttgctatcaggaaaatatacatgtatagaaattagtcattggaagtcttaactagtaacatctcctagtac

SEQ ID NO: 41500 - DNA, 406 bp, Homo sapiens
agatggattggatttttcaacctcattggaagccagaagacaatggggtggatttcctgtttcagtgacatggtagcttgagctaaagttagaaccgctcccattacaatcacttaaaatgctatataagctataacaacagaataagaaagaaaaacagagaaccgaaagcaaagcaggaatataaagccagagcagagtaggcagctctggggaggggcaaggtgggttcattggaccctgaaatcgaccctaacaataatagaggtttggatttgcatgaacacgtgaagcatggagttgaaacagaaatcccctcaaaagagccattcccaggtaaaagggatgcaagaaaatttcccccatgggatcagagaaatgtcaagggagctgatcattgccccac

SEQ ID NO: 41501 - DNA, 423 bp, Homo sapiens
gaaatttgccaacgatgcttataagacaggtttcatcttggcaaatttacttcgtctctctacctagaacactctacaactcccagaaaattccaatgtactcaagggtccatgcaattgaagggtgctgatgatgctgaagcataatttacttccttgggaatccacctctggtcagtagaatgtctaaatgcattttgtttcccaaatgttgcctcttagggatatgagaaaaaagttacattgcatcgttttgtaacagttgctctataactaaaactgacagtatctgtattgtgtctatattcaattctaacttaaaagacacataacccgtaaacttattacagtgccaagcaataaaaagcaaaattcatttacacttatttgtctcaaaaattcttgtcaagaaagcttggttat

SEQ ID NO: 41502 - DNA, 2870 bp, Homo sapiens
gcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagaaacatcacagaaaattctttgatttatcttaatagtgacaagtgagcctgcttctgtcaattactgaagctataaggagattttttaaaaattaaacttcaacacaatgaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatgcagtgttgatggtagatgatgacacactcatcagcaccccagaccttgtttttgctttctcagtttggcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctttttcactaaaggtcagttgttttaatttgaaacctgaaatgcctctttagcaaaagcctgtggtatggggtaaagccatgtaagaagagaatagtctcagtcacatatgaagaggaaaatttgcagctgccagtgctttccttgtggccctgccaaccagctcttccaggacgaactcagtccagcatggttttgatgtaaccatccatgcttttatttttgttaagtcttttgtgactgggacagttaattttagtagctgaagaacgtctagttgtttgcttgatatttgtgaacatttactgcatggatcacaaaacaatataccctgtatttcttacacgccacttatatgcagcaaggagtaaatgtgttactagattcgggtagtgcattttgtcactgaatctgaccttgagaatgtacattaattcttatattttacataatgtatgtgttgtttaagaaatgtataaaaaacctgaaaaaaatgagtaagaactggcagaagttaaaaccctttgtatcaaaagatctttattggtagagcactggttatcttctggatactaaaaagttgtattacaaagccaaacacttgcattcacaactttaaaaaaagatccaaggaactattcataatgatgaaattccaactacatacaaggaggagaaaataagaacccagtcataacagaggaattctataggagtctgcatcaattcattcttaaggttgcctactctctgttatgtgaattagcgtctgtgtttcacccattgtctgtgtttagtccttgttcaccactagggcaaggaattcttaactaggcctctgtttaccaacttctctttctcctcctttccctcttattcctccttctcctcttccttcttatataatgctagtatattctcaaaattgcaaagctgtgagaatattaaaataatcatggctaatgttccaataatgaggtctttgtgcatttagttccgcatatgatggttttttttttacattaaagagtatatgtgtcttaatgcagtcagattgtaaaaaacaaaaacaaagaaactaagaatcttactaaaaatcgataatgtcagttatctgttttgtccaatattggtagtacttttttgcctcttatgattcctctagcagataaataaaagaaacttttgccatcc

SEQ ID NO: 41503 - DNA, 605 bp, Homo sapiens
gcggccactcggggactgtcccttgctccaggcgctcactttgcgggcggcactttttccaggttgttaatccagctaatggagaaggatagatgcacgctacttggtttagaaaaaaaaacaaaaatgagcaaacgagacgccccttccgttttatgataactaagctgcagggaaataaatcggctggccctactgcaatctactgcactcgagtgacaagtgagcctgcttctgtcaattactgaagctataaggagattttttaaaaattaaacttcaacacaatgagatttgtgaaaaaagtaacaggaattaagaagaacctcgtaagaatagaagagctacttaggaaaaagggaggggaaatcattttggaaggagagcatagaattggtagaaaatgagaaaagctgtatggcatttctaaaacaacaatgaaaagaatgactttcctgaatgtgggtaaaaaccttacatcaaaaactcttccccgaatcttgtatagcacctggaaaagacttgtgaagaaaaatgacctttcatgtaccatttctggcattttgtattttgcaatgcaataaattctagtttatgctgcttat
